(12) United States Patent
Bernett et al.

(10) Patent No.: US 11,524,991 B2
(45) Date of Patent: Dec. 13, 2022

(54) PD-1 TARGETED HETERODIMERIC FUSION PROTEINS CONTAINING IL-15/IL-15RA FC-FUSION PROTEINS AND PD-1 ANTIGEN BINDING DOMAINS AND USES THEREOF

(71) Applicant: Xencor, Inc., Monrovia, CA (US)

(72) Inventors: Matthew Bernett, Monrovia, CA (US); John Desjarlais, Pasadena, CA (US); Rumana Rashid, Temple City, CA (US); Rajat Varma, Monrovia, CA (US); Christine Bonzon, Los Angeles, CA (US)

(73) Assignee: Xencor, Inc., Monrovia, CA (US)

( * ) Notice: Subject to any disclaimer, the term of this patent is extended or adjusted under 35 U.S.C. 154(b) by 191 days.

(21) Appl. No.: 16/388,811

(22) Filed: Apr. 18, 2019

(65) Prior Publication Data

US 2019/0389933 A1    Dec. 26, 2019

Related U.S. Application Data

(60) Provisional application No. 62/659,571, filed on Apr. 18, 2018.

(51) Int. Cl.
| | | |
|---|---|---|
| *C07K 16/28* | (2006.01) | |
| *A61K 39/395* | (2006.01) | |
| *C07K 14/715* | (2006.01) | |
| *A61K 38/17* | (2006.01) | |
| *C12N 15/63* | (2006.01) | |
| *A61K 38/20* | (2006.01) | |
| *C07K 14/54* | (2006.01) | |

(52) U.S. Cl.
CPC ...... *C07K 14/7155* (2013.01); *A61K 38/1793* (2013.01); *A61K 38/2086* (2013.01); *A61K 39/3955* (2013.01); *C07K 14/5443* (2013.01); *C12N 15/63* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,773,919 A | 11/1973 | Boswell et al. |
| 4,169,888 A | 10/1979 | Hanka et al. |
| 4,179,337 A | 12/1979 | Davis et al. |
| 4,256,746 A | 3/1981 | Miyashita et al. |
| 4,294,757 A | 10/1981 | Asai |
| 4,301,144 A | 11/1981 | Iwashita et al. |
| 4,307,016 A | 12/1981 | Asai et al. |
| 4,313,946 A | 2/1982 | Powell et al. |
| 4,315,929 A | 2/1982 | Freedman et al. |
| 4,322,348 A | 3/1982 | Asai et al. |
| 4,331,598 A | 5/1982 | Hasegawa et al. |
| 4,361,650 A | 5/1982 | Asai et al. |
| 4,362,663 A | 12/1982 | Kida et al. |
| 4,364,866 A | 12/1982 | Asai et al. |
| 4,364,935 A | 12/1982 | Kung et al. |
| 4,371,533 A | 2/1983 | Akimoto et al. |
| 4,424,219 A | 1/1984 | Hashimoto et al. |
| 4,450,254 A | 5/1984 | Isley et al. |
| 4,496,689 A | 1/1985 | Mitra |
| 4,640,835 A | 2/1987 | Shimizu et al. |
| 4,670,417 A | 6/1987 | Iwasaki et al. |
| 4,791,192 A | 12/1988 | Nakagawa et al. |
| 4,880,935 A | 11/1989 | Thorpe |
| 4,923,990 A | 5/1990 | Nakano et al. |
| 4,943,533 A | 7/1990 | Mendelsohn et al. |
| 4,970,198 A | 11/1990 | Lee et al. |
| 5,053,394 A | 10/1991 | Ellestad et al. |
| 5,070,092 A | 12/1991 | Kanda et al. |
| 5,084,468 A | 1/1992 | Saito et al. |
| 5,101,038 A | 3/1992 | Nakano et al. |
| 5,122,368 A | 6/1992 | Greenfield et al. |
| 5,187,186 A | 2/1993 | Kanda et al. |
| 5,208,020 A | 5/1993 | Chari et al. |
| 5,264,586 A | 11/1993 | Nicolaou et al. |
| 5,384,412 A | 1/1995 | Nicolaou et al. |
| 5,416,064 A | 5/1995 | Chari et al. |
| 5,475,092 A | 12/1995 | Chari et al. |

(Continued)

FOREIGN PATENT DOCUMENTS

| | | |
|---|---|---|
| EP | 0425235 B1 | 9/1996 |
| EP | 2724728 | 4/2002 |
| EP | 0927254 | 6/2005 |
| EP | 1752471 | 2/2007 |
| EP | 1829895 | 5/2007 |
| EP | 3263581 | 1/2008 |
| EP | 2006381 | 12/2008 |
| EP | 2009101 A1 | 12/2008 |
| EP | 1801119 B1 | 6/2009 |
| EP | 2194066 | 6/2010 |

(Continued)

OTHER PUBLICATIONS

Fabbi et al, Journal of Cytokine Biology, 2016, vol. 1, No. 2, pp. 1-7.*
Mathios et al, International Journal of Cancer, 2016; vol. 138, pp. 187-194.*
Kowalsky et al, Molecular Therapy; 2018; vol. 26 No. 10, pp. 2476-2486.*
U.S. Appl. No. 12/631,508, filed Dec. 4, 2009, Chari et al.
(No Author Name) "A method for making multispecific antibodies having heteromultimeric and common components", Expert Opinion on Therapeutic Patents, Genentech, Inc. (1999) 9(6): 785-790, pp. 785-790.

(Continued)

*Primary Examiner* — Bridget E Bunner
*Assistant Examiner* — Fozia M Hamud
(74) *Attorney, Agent, or Firm* — Kelly A. Plummer; Christopher J. Betti; Morgan, Lewis & Bockius, LLP

(57) ABSTRACT

The present invention is directed to novel PD-1-targeted IL-15/Rα-Fc fusion proteins comprising an IL-15/IL-15Rα Fc-fusion protein and a PD-1 antigen binding domain. The PD-1-targeted IL-15/Rα-Fc fusion proteins can be administered to a patient to treat cancer.

17 Claims, 308 Drawing Sheets

Specification includes a Sequence Listing.

(56) References Cited

U.S. PATENT DOCUMENTS

| | | |
|---|---|---|
| 5,500,362 A | 3/1996 | Robinson et al. |
| 5,530,101 A | 6/1996 | Queen et al. |
| 5,541,087 A | 7/1996 | Lo et al. |
| 5,550,246 A | 8/1996 | Nicolaou et al. |
| 5,558,864 A | 9/1996 | Bendig et al. |
| 5,585,089 A | 12/1996 | Queen et al. |
| 5,585,097 A | 12/1996 | Bolt et al. |
| 5,585,499 A | 12/1996 | Chari et al. |
| 5,622,929 A | 4/1997 | Willner et al. |
| 5,635,483 A | 6/1997 | Pettit et al. |
| 5,641,780 A | 6/1997 | Amishiro et al. |
| 5,663,149 A | 9/1997 | Pettit et al. |
| 5,677,171 A | 10/1997 | Hudziak et al. |
| 5,693,761 A | 12/1997 | Queen et al. |
| 5,693,762 A | 12/1997 | Queen et al. |
| 5,703,080 A | 12/1997 | Nakakura et al. |
| 5,712,374 A | 1/1998 | Kuntsmann et al. |
| 5,714,586 A | 2/1998 | Kuntsmann et al. |
| 5,726,044 A | 3/1998 | Lo et al. |
| 5,731,168 A | 3/1998 | Carter et al. |
| 5,736,137 A | 4/1998 | Anderson et al. |
| 5,739,116 A | 4/1998 | Hamann et al. |
| 5,767,237 A | 6/1998 | Sakakibara et al. |
| 5,767,285 A | 6/1998 | Hamann et al. |
| 5,770,701 A | 6/1998 | McGahren et al. |
| 5,770,710 A | 6/1998 | McGahren et al. |
| 5,773,001 A | 6/1998 | Hamann et al. |
| 5,780,588 A | 7/1998 | Pettit et al. |
| 5,807,706 A | 9/1998 | Carter et al. |
| 5,821,333 A | 10/1998 | Carter et al. |
| 5,821,337 A | 10/1998 | Carter et al. |
| 5,824,805 A | 10/1998 | King et al. |
| 5,846,545 A | 12/1998 | Chari et al. |
| 5,859,205 A | 1/1999 | Adair et al. |
| 5,877,291 A | 3/1999 | Mezes et al. |
| 5,877,296 A | 3/1999 | Hamann et al. |
| 5,891,996 A | 4/1999 | Mateo de Acosta del Rio et al. |
| 5,892,020 A | 4/1999 | Mezes et al. |
| 5,945,311 A | 8/1999 | Lindhofer et al. |
| 5,968,509 A | 10/1999 | Gorman et al. |
| 6,054,297 A | 4/2000 | Carter et al. |
| 6,071,515 A | 6/2000 | Mezes et al. |
| 6,124,431 A | 9/2000 | Sakakibara et al. |
| 6,180,370 B1 | 1/2001 | Queen et al. |
| 6,214,345 B1 | 4/2001 | Firestone et al. |
| 6,235,883 B1 | 5/2001 | Jakobovits et al. |
| 6,329,507 B1 | 12/2001 | Mezes et al. |
| 6,407,213 B1 | 6/2002 | Carter et al. |
| 6,441,163 B1 | 8/2002 | Chari et al. |
| 6,455,677 B1 | 9/2002 | Park et al. |
| 6,506,883 B2 | 1/2003 | Meteo de Acosta del Rio et al. |
| 6,602,684 B1 | 8/2003 | Umana et al. |
| 6,632,927 B2 | 10/2003 | Adair et al. |
| 6,706,265 B1 | 3/2004 | Bolt et al. |
| 6,716,410 B1 | 4/2004 | Witztum |
| 6,723,538 B2 | 4/2004 | Mack et al. |
| 6,737,056 B1 | 5/2004 | Presta |
| 6,884,869 B2 | 4/2005 | Senter et al. |
| 6,989,452 B2 | 1/2006 | Ng et al. |
| 7,087,600 B2 | 8/2006 | Ng et al. |
| 7,112,324 B1 | 9/2006 | Dorken et al. |
| 7,129,261 B2 | 10/2006 | Ng et al. |
| 7,276,497 B2 | 10/2007 | Chari et al. |
| 7,276,585 B2 | 10/2007 | Lazar et al. |
| 7,303,749 B1 | 12/2007 | Chari |
| 7,355,008 B2 | 4/2008 | Stavenhagen et al. |
| 7,368,565 B2 | 5/2008 | Chari et al. |
| 7,498,302 B2 | 3/2009 | Ng et al. |
| 7,507,420 B2 | 3/2009 | Ng et al. |
| 7,517,903 B2 | 4/2009 | Chen et al. |
| 7,601,354 B2 | 10/2009 | Chari |
| 7,632,497 B2 | 12/2009 | Stavenhagen |
| 7,642,228 B2 | 1/2010 | Carter et al. |
| 7,691,962 B2 | 4/2010 | Boyd et al. |
| 7,695,936 B2 | 4/2010 | Carter et al. |
| 7,696,338 B2 | 4/2010 | Neville, Jr. et al. |
| 7,728,114 B2 | 6/2010 | Mach et al. |
| 7,834,152 B2 | 11/2010 | Strom et al. |
| 7,858,081 B2 | 12/2010 | Bernard et al. |
| 7,960,512 B2 | 6/2011 | Stavenhagen et al. |
| 8,003,774 B2 | 8/2011 | Stavenhagen et al. |
| 8,063,187 B2 | 11/2011 | Chu et al. |
| 8,114,967 B2 | 2/2012 | Bhatt et al. |
| 8,124,084 B2 | 2/2012 | LeFrancois et al. |
| 8,192,737 B2 | 6/2012 | Stavenhagen et al. |
| 8,216,574 B2 | 7/2012 | Stavenhagen |
| 8,216,805 B2 | 7/2012 | Carter et al. |
| 8,236,308 B2 | 8/2012 | Kischel et al. |
| 8,309,690 B2 | 11/2012 | Allan et al. |
| 8,367,805 B2 | 2/2013 | Chamberlain et al. |
| 8,409,568 B2 | 4/2013 | Gao et al. |
| 8,592,562 B2 | 11/2013 | Kannan et al. |
| 8,629,245 B2 | 1/2014 | Georgiou et al. |
| 8,637,641 B2 | 1/2014 | Dahiyat et al. |
| 8,679,493 B2 | 3/2014 | Georgiou et al. |
| 8,742,074 B2 | 6/2014 | Behrens et al. |
| 8,871,912 B2 | 10/2014 | Davis et al. |
| 8,940,288 B2 | 1/2015 | LeFrancois et al. |
| 8,940,289 B2 | 1/2015 | Wong et al. |
| 8,946,387 B2 | 2/2015 | Koenig et al. |
| 8,951,517 B2 | 2/2015 | Stavenhagen et al. |
| 9,028,815 B2 | 5/2015 | Stavenhagen et al. |
| 9,150,663 B2 | 10/2015 | Labrijn et al. |
| 9,308,258 B2 | 4/2016 | Kannan et al. |
| RE45,992 E | 5/2016 | Behrens et al. |
| 9,365,630 B2 | 6/2016 | LeFrancois et al. |
| 9,371,368 B2 | 6/2016 | LeFrancois et al. |
| 9,464,127 B2 | 10/2016 | Wong et al. |
| 9,493,533 B2 | 11/2016 | Bernard et al. |
| 9,505,848 B2 | 11/2016 | Davis et al. |
| 9,527,926 B2 | 12/2016 | Ho et al. |
| 9,562,109 B2 | 2/2017 | Von Kreudenstein et al. |
| 9,683,052 B2 | 6/2017 | Blein et al. |
| 9,683,053 B2 | 6/2017 | Blein et al. |
| 9,763,705 B2 | 9/2017 | Faulhaber |
| 9,763,765 B2 | 9/2017 | Horan et al. |
| 9,822,181 B2 | 11/2017 | Bonvini et al. |
| 9,856,327 B2 | 1/2018 | Bernett et al. |
| 9,931,377 B2 | 4/2018 | Pavlakis et al. |
| 9,932,387 B2 | 4/2018 | LeFrancois et al. |
| 9,969,790 B2 | 5/2018 | LeFrancois et al. |
| 10,011,858 B2 | 7/2018 | Igawa et al. |
| 10,138,303 B2 | 11/2018 | Ho et al. |
| 10,350,270 B2 | 7/2019 | McCauley |
| 2001/0035606 A1 | 11/2001 | Schoen |
| 2002/0076406 A1 | 6/2002 | Leung |
| 2002/0103345 A1 | 8/2002 | Zhu |
| 2002/0131968 A1 | 9/2002 | Waldmann et al. |
| 2003/0003097 A1 | 1/2003 | Reft et al. |
| 2003/0017979 A1 | 1/2003 | Mack et al. |
| 2003/0091561 A1 | 5/2003 | Van de Winkel |
| 2003/0157108 A1 | 8/2003 | Presta |
| 2003/0223999 A1 | 12/2003 | Lindhofer |
| 2004/0018191 A1 | 1/2004 | Wang |
| 2004/0071696 A1 | 4/2004 | Adams et al. |
| 2004/0162411 A1 | 8/2004 | Lanzavecchia |
| 2004/0170626 A1 | 9/2004 | Schuurman |
| 2004/0242851 A1 | 12/2004 | Zhu |
| 2005/0114037 A1 | 5/2005 | Desjarlais et al. |
| 2005/0136050 A1 | 6/2005 | Kufer et al. |
| 2005/0142133 A1 | 6/2005 | Lazar et al. |
| 2005/0176028 A1 | 8/2005 | Hofmeiser et al. |
| 2005/0191702 A1 | 9/2005 | Mack et al. |
| 2005/0238648 A1 | 10/2005 | Jacobs |
| 2005/0238649 A1 | 10/2005 | Doronina |
| 2006/0008883 A1 | 1/2006 | Lazar |
| 2006/0018897 A1 | 1/2006 | Lee et al. |
| 2006/0024298 A1 | 2/2006 | Lazar et al. |
| 2006/0024317 A1 | 2/2006 | Boyd |
| 2006/0073142 A1 | 4/2006 | Chan et al. |
| 2006/0074008 A1 | 4/2006 | Senter |
| 2006/0115481 A1 | 6/2006 | Lindhofer et al. |
| 2006/0121032 A1 | 6/2006 | Dahiyat et al. |
| 2006/0134105 A1 | 6/2006 | Lazar et al. |

(56) References Cited

U.S. PATENT DOCUMENTS

| | | |
|---|---|---|
| 2006/0235208 A1 | 10/2006 | Lazar |
| 2006/0257361 A1 | 11/2006 | Watanabe et al. |
| 2006/0263857 A1 | 11/2006 | LeFrancois et al. |
| 2007/0071675 A1 | 3/2007 | Wu et al. |
| 2007/0105199 A1 | 5/2007 | Yan et al. |
| 2007/0123479 A1 | 5/2007 | Kufer et al. |
| 2007/0148170 A1 | 6/2007 | Desjarlais |
| 2007/0287170 A1 | 12/2007 | Davis et al. |
| 2008/0044413 A1 | 2/2008 | Hammond et al. |
| 2008/0050370 A1 | 2/2008 | Glaser et al. |
| 2008/0138335 A1 | 6/2008 | Takahashi et al. |
| 2008/0213273 A1 | 9/2008 | Burge |
| 2008/0219974 A1 | 9/2008 | Bernett et al. |
| 2008/0242845 A1 | 10/2008 | Lazar et al. |
| 2009/0082213 A1 | 3/2009 | Horowitz et al. |
| 2009/0163699 A1 | 6/2009 | Desjarlais |
| 2009/0214539 A1 | 8/2009 | Grosmaire et al. |
| 2009/0238791 A1 | 9/2009 | Jacques et al. |
| 2009/0252683 A1 | 10/2009 | Kischel et al. |
| 2009/0252729 A1 | 10/2009 | Farrington et al. |
| 2009/0274692 A1 | 11/2009 | Tan et al. |
| 2009/0311253 A1 | 12/2009 | Ghayur et al. |
| 2009/0317869 A1 | 12/2009 | Alley et al. |
| 2010/0004431 A1 | 1/2010 | Bernett et al. |
| 2010/0015133 A1 | 1/2010 | Igawa et al. |
| 2010/0080814 A1 | 4/2010 | Desjarlais et al. |
| 2010/0150918 A1 | 6/2010 | Kufer et al. |
| 2010/0174053 A1 | 7/2010 | Johnson et al. |
| 2010/0178298 A1 | 7/2010 | Lindhofer |
| 2010/0183554 A1 | 7/2010 | Mach et al. |
| 2010/0226925 A1 | 9/2010 | Dillon et al. |
| 2010/0239567 A1 | 9/2010 | Esue |
| 2010/0239582 A1 | 9/2010 | Humphreys et al. |
| 2010/0256339 A1 | 10/2010 | Bossenmaier et al. |
| 2010/0256340 A1 | 10/2010 | Brinkmann et al. |
| 2010/0267934 A1 | 10/2010 | Van de Winkel et al. |
| 2010/0298542 A1 | 11/2010 | Igawa et al. |
| 2010/0322933 A1 | 12/2010 | Lindhofer et al. |
| 2010/0330089 A1 | 12/2010 | Damle et al. |
| 2010/0331527 A1 | 12/2010 | Davis et al. |
| 2011/0054151 A1 | 3/2011 | Lazar et al. |
| 2011/0076275 A1 | 3/2011 | Igawa et al. |
| 2011/0177500 A1 | 7/2011 | Winther et al. |
| 2011/0189178 A1 | 8/2011 | Desjarlais et al. |
| 2011/0189209 A1 | 8/2011 | Neville, Jr. et al. |
| 2011/0201032 A1 | 8/2011 | Zeng et al. |
| 2011/0217302 A1 | 9/2011 | Odegard et al. |
| 2011/0262439 A1 | 10/2011 | Kufer et al. |
| 2011/0275787 A1 | 11/2011 | Kufer et al. |
| 2011/0293619 A1 | 12/2011 | Kufer et al. |
| 2012/0028304 A1 | 2/2012 | Dahiyat et al. |
| 2012/0034228 A1 | 2/2012 | Kufer et al. |
| 2012/0121597 A1 | 5/2012 | Ho et al. |
| 2012/0149876 A1 | 6/2012 | Von Kreudenstein et al. |
| 2012/0156207 A1 | 6/2012 | Chu et al. |
| 2012/0177595 A1 | 7/2012 | Wong et al. |
| 2012/0251531 A1 | 10/2012 | Baehner et al. |
| 2012/0251541 A1 | 10/2012 | Baurin et al. |
| 2013/0039913 A1 | 2/2013 | Labrijn et al. |
| 2013/0089541 A1 | 4/2013 | D'Angelo et al. |
| 2013/0095097 A1 | 4/2013 | Blakenship et al. |
| 2013/0101586 A1 | 4/2013 | Riegler et al. |
| 2013/0115208 A1 | 5/2013 | Ho et al. |
| 2013/0129723 A1 | 5/2013 | Blakenship et al. |
| 2013/0131319 A1 | 5/2013 | Igawa et al. |
| 2013/0142793 A1 | 6/2013 | Ledbetter et al. |
| 2013/0171095 A1 | 7/2013 | Bernett et al. |
| 2013/0178605 A1 | 7/2013 | Blein et al. |
| 2013/0195849 A1 | 8/2013 | Von Kreudenstein et al. |
| 2013/0209355 A1 | 8/2013 | De Weers et al. |
| 2013/0267686 A1 | 10/2013 | Brinkmann |
| 2013/0336981 A1 | 12/2013 | de Kruif et al. |
| 2014/0024111 A1 | 1/2014 | Kannan et al. |
| 2014/0056879 A1 | 2/2014 | Lazar |
| 2014/0072581 A1 | 3/2014 | Dixit et al. |
| 2014/0086916 A1 | 3/2014 | Zha |
| 2014/0187753 A1 | 7/2014 | Blein et al. |
| 2014/0199294 A1 | 7/2014 | Mimoto et al. |
| 2014/0212435 A1 | 7/2014 | Moore et al. |
| 2014/0212436 A1 | 7/2014 | Moore et al. |
| 2014/0249297 A1 | 9/2014 | Lazar et al. |
| 2014/0288275 A1 | 9/2014 | Moore et al. |
| 2014/0294759 A1 | 10/2014 | Chu et al. |
| 2014/0294823 A1 | 10/2014 | Moore et al. |
| 2014/0294833 A1 | 10/2014 | Desjarlais et al. |
| 2014/0294835 A1 | 10/2014 | Moore et al. |
| 2014/0294836 A1 | 10/2014 | Chu et al. |
| 2014/0302064 A1 | 10/2014 | Moore |
| 2014/0322217 A1 | 10/2014 | Moore et al. |
| 2014/0335089 A1 | 11/2014 | Igawa et al. |
| 2014/0356381 A1 | 12/2014 | Moore et al. |
| 2014/0363426 A1 | 12/2014 | Moore et al. |
| 2014/0370013 A1 | 12/2014 | Desjarlais et al. |
| 2014/0370020 A1 | 12/2014 | Kuramochi et al. |
| 2014/0377269 A1 | 12/2014 | Mabry et al. |
| 2014/0377270 A1 | 12/2014 | Moore et al. |
| 2015/0071948 A1 | 3/2015 | Lazar et al. |
| 2015/0307629 A1 | 10/2015 | Bernett et al. |
| 2015/0351275 A1 | 12/2015 | Imbimbo et al. |
| 2016/0060360 A1 | 3/2016 | Moore et al. |
| 2016/0068584 A1 | 3/2016 | Bechard et al. |
| 2016/0068588 A1 | 3/2016 | Bernett et al. |
| 2016/0157951 A1 | 6/2016 | Schoenig et al. |
| 2016/0175459 A1 | 6/2016 | Gey et al. |
| 2016/0176969 A1 | 6/2016 | Bernett et al. |
| 2016/0184399 A1 | 6/2016 | Bechard et al. |
| 2016/0215063 A1 | 7/2016 | Bernett et al. |
| 2016/0229924 A1 | 8/2016 | Bernett et al. |
| 2016/0318986 A1 | 11/2016 | Morisseau et al. |
| 2016/0333067 A1 | 11/2016 | LeFrancois et al. |
| 2016/0347818 A1 | 12/2016 | LeFrancois et al. |
| 2016/0355608 A1 | 12/2016 | Bernett et al. |
| 2016/0367635 A1 | 12/2016 | Wong et al. |
| 2017/0020963 A1 | 1/2017 | Qu et al. |
| 2017/0056874 A1 | 3/2017 | Bechard et al. |
| 2017/0088597 A1 | 3/2017 | Wong et al. |
| 2017/0145078 A1 | 5/2017 | Davis et al. |
| 2017/0151310 A1 | 6/2017 | Felber et al. |
| 2017/0233497 A1 | 8/2017 | Labrijn et al. |
| 2018/0094077 A1 | 4/2018 | Blein et al. |
| 2018/0118805 A1 | 5/2018 | Bernett et al. |
| 2018/0118828 A1 | 5/2018 | Bernett et al. |
| 2018/0118836 A1 | 5/2018 | Bernett et al. |
| 2018/0127501 A1 | 5/2018 | Bernett et al. |
| 2018/0194860 A1 | 7/2018 | Von Kreudenstein et al. |
| 2018/0200366 A1 | 7/2018 | Wong et al. |
| 2018/0298079 A1 | 10/2018 | LeFrancois et al. |
| 2018/0312560 A1 | 11/2018 | Morisseau et al. |
| 2019/0016778 A1 | 1/2019 | Bernett et al. |
| 2019/0263877 A1 | 8/2019 | Yeung et al. |
| 2020/0247862 A1 | 8/2020 | Bernett et al. |
| 2021/0047407 A1 | 2/2021 | Christian et al. |

FOREIGN PATENT DOCUMENTS

| | | |
|---|---|---|
| EP | 2202245 A1 | 6/2010 |
| EP | 2522724 | 6/2011 |
| EP | 1718670 | 7/2011 |
| EP | 1934353 | 10/2011 |
| EP | 2155788 | 2/2014 |
| EP | 2388266 | 4/2014 |
| EP | 3093295 | 11/2016 |
| EP | 2769984 | 8/2017 |
| EP | 3235830 | 10/2017 |
| EP | 3252078 | 12/2017 |
| EP | 3030575 | 7/2018 |
| EP | 3265478 B1 | 9/2019 |
| EP | 3030262 B1 | 10/2019 |
| EP | 1899364 B1 | 2/2020 |
| WO | WO8705330 | 9/1987 |
| WO | WO9211018 | 7/1992 |
| WO | WO9321232 | 10/1993 |
| WO | WO9413804 | 5/1994 |
| WO | WO9520045 | 1/1995 |

(56) References Cited

FOREIGN PATENT DOCUMENTS

| | | |
|---|---|---|
| WO | WO9640210 | 6/1996 |
| WO | WO96027011 | 9/1996 |
| WO | WO1997041232 | 11/1997 |
| WO | WO98050431 | 11/1998 |
| WO | WO199937791 | 7/1999 |
| WO | WO99054440 | 10/1999 |
| WO | WO99066951 | 12/1999 |
| WO | WO200061739 A1 | 10/2000 |
| WO | WO2001010912 A1 | 2/2001 |
| WO | WO200124763 A2 | 4/2001 |
| WO | WO200129246 A1 | 4/2001 |
| WO | WO200162931 A1 | 8/2001 |
| WO | WO200188138 | 11/2001 |
| WO | WO2001083525 | 11/2001 |
| WO | WO2001090192 | 11/2001 |
| WO | WO200216368 | 2/2002 |
| WO | WO200230954 A1 | 4/2002 |
| WO | WO200231140 A1 | 4/2002 |
| WO | WO2002088172 A2 | 7/2002 |
| WO | WO2002062850 | 8/2002 |
| WO | WO2002083180 | 10/2002 |
| WO | WO2002098883 | 12/2002 |
| WO | WO2004010957 | 2/2004 |
| WO | WO2004043493 | 5/2004 |
| WO | WO2004103272 | 12/2004 |
| WO | WO2004106383 | 12/2004 |
| WO | WO2005014642 A2 | 2/2005 |
| WO | WO2005063816 | 7/2005 |
| WO | WO2005085282 | 9/2005 |
| WO | WO2005112919 A2 | 12/2005 |
| WO | WO2005118635 | 12/2005 |
| WO | WO2006020258 | 2/2006 |
| WO | WO2006034488 | 3/2006 |
| WO | WO2006036834 | 4/2006 |
| WO | WO2006063974 | 6/2006 |
| WO | WO2006072620 | 7/2006 |
| WO | WO2006110476 A2 | 10/2006 |
| WO | WO2006106905 | 12/2006 |
| WO | WO2007001677 | 1/2007 |
| WO | WO2007005612 | 1/2007 |
| WO | WO2007018431 A2 | 2/2007 |
| WO | WO2007033230 | 3/2007 |
| WO | WO2007042261 | 4/2007 |
| WO | WO2007046006 | 4/2007 |
| WO | WO2007047829 | 4/2007 |
| WO | WO2007059404 A2 | 5/2007 |
| WO | WO2007062037 | 5/2007 |
| WO | WO2007084342 | 7/2007 |
| WO | WO2007089149 A2 | 8/2007 |
| WO | WO2007093630 | 8/2007 |
| WO | WO2007098934 | 9/2007 |
| WO | WO2007110205 | 10/2007 |
| WO | WO2007113648 | 10/2007 |
| WO | WO2007128563 A1 | 11/2007 |
| WO | WO2007147901 | 12/2007 |
| WO | WO20070147901 | 12/2007 |
| WO | WO2008003103 | 1/2008 |
| WO | WO2008003115 | 1/2008 |
| WO | WO2008003116 | 1/2008 |
| WO | WO2008119096 | 10/2008 |
| WO | WO2008119566 | 10/2008 |
| WO | WO2008124858 | 10/2008 |
| WO | WO2008143794 | 11/2008 |
| WO | WO2008145142 | 12/2008 |
| WO | WO2008150494 | 12/2008 |
| WO | WO2009000006 | 12/2008 |
| WO | WO2009002562 | 12/2008 |
| WO | WO2009017394 A1 | 2/2009 |
| WO | WO2009017823 | 2/2009 |
| WO | WO2009030734 | 3/2009 |
| WO | WO2009032782 | 3/2009 |
| WO | WO2009036209 | 3/2009 |
| WO | WO2009086320 | 7/2009 |
| WO | WO2009089004 | 7/2009 |
| WO | WO2009106096 | 9/2009 |
| WO | WO2009106321 | 9/2009 |
| WO | WO2010017103 | 2/2010 |
| WO | WO2010028796 | 3/2010 |
| WO | WO2010033736 | 3/2010 |
| WO | WO2010034441 | 4/2010 |
| WO | WO2010037835 | 4/2010 |
| WO | WO2010042904 | 4/2010 |
| WO | WO2010062171 A2 | 6/2010 |
| WO | WO2010085682 | 7/2010 |
| WO | WO2010106180 | 9/2010 |
| WO | WO2010115551 | 10/2010 |
| WO | WO2010115552 | 10/2010 |
| WO | WO2010115553 | 10/2010 |
| WO | WO2010115589 | 10/2010 |
| WO | WO2010119119 | 10/2010 |
| WO | WO20100112193 | 10/2010 |
| WO | WO2010136172 | 12/2010 |
| WO | WO2010151792 | 12/2010 |
| WO | WO2010151808 | 12/2010 |
| WO | WO2011005621 | 1/2011 |
| WO | WO2011020047 A1 | 2/2011 |
| WO | WO2011028952 | 3/2011 |
| WO | WO2011036183 | 3/2011 |
| WO | WO2011066342 | 3/2011 |
| WO | WO2011051307 | 5/2011 |
| WO | WO2011063348 | 5/2011 |
| WO | WO2011066501 | 6/2011 |
| WO | WO2011121110 | 10/2011 |
| WO | WO2011131746 | 10/2011 |
| WO | WO2011133886 | 10/2011 |
| WO | WO2011143545 | 11/2011 |
| WO | WO2011131746 | 12/2011 |
| WO | WO2011159877 | 12/2011 |
| WO | WO2012016227 | 2/2012 |
| WO | WO2012018687 | 2/2012 |
| WO | WO2012032080 | 3/2012 |
| WO | WO2012040323 A2 | 3/2012 |
| WO | WO2012058768 | 5/2012 |
| WO | WO2012062596 | 5/2012 |
| WO | WO2012107417 | 8/2012 |
| WO | WO2012116453 | 9/2012 |
| WO | WO2012125495 | 9/2012 |
| WO | WO2012125850 | 9/2012 |
| WO | WO2012131555 | 10/2012 |
| WO | WO2012146394 | 11/2012 |
| WO | WO2012146628 | 11/2012 |
| WO | WO2012162067 | 11/2012 |
| WO | WO2012131555 | 12/2012 |
| WO | WO2012175222 | 12/2012 |
| WO | WO2013006544 | 1/2013 |
| WO | WO2013016714 | 1/2013 |
| WO | WO2013022855 | 2/2013 |
| WO | WO2013026833 | 2/2013 |
| WO | WO2013033008 | 3/2013 |
| WO | WO2013/055809 | 4/2013 |
| WO | WO2013047748 | 4/2013 |
| WO | WO2013055809 | 4/2013 |
| WO | WO2013063702 | 5/2013 |
| WO | WO2013096828 | 6/2013 |
| WO | WO2013107791 A1 | 7/2013 |
| WO | WO2013125667 | 8/2013 |
| WO | WO2013164694 | 11/2013 |
| WO | WO2013180201 | 12/2013 |
| WO | WO2014004586 | 1/2014 |
| WO | WO2014012085 | 1/2014 |
| WO | WO2014047231 | 3/2014 |
| WO | WO2014056783 | 4/2014 |
| WO | WO2014079000 | 5/2014 |
| WO | WO2014/110601 | 7/2014 |
| WO | WO2014110601 | 7/2014 |
| WO | WO2014113510 | 7/2014 |
| WO | WO2014145806 | 9/2014 |
| WO | WO2014145907 | 9/2014 |
| WO | WO2014164553 | 10/2014 |
| WO | WO2014170032 | 10/2014 |
| WO | WO2014207064 | 12/2014 |
| WO | WO2014207173 | 12/2014 |
| WO | WO2014209804 | 12/2014 |
| WO | WO2015018528 | 2/2015 |

(56) References Cited

FOREIGN PATENT DOCUMENTS

| | | |
|---|---|---|
| WO | WO2015018529 | 2/2015 |
| WO | WO2015026892 | 2/2015 |
| WO | WO2015063339 | 5/2015 |
| WO | WO2015095392 | 6/2015 |
| WO | WO2015095410 | 6/2015 |
| WO | WO2015095423 | 6/2015 |
| WO | WO2015103072 | 7/2015 |
| WO | WO2015103928 | 7/2015 |
| WO | WO2015131994 | 9/2015 |
| WO | WO2015143079 | 9/2015 |
| WO | WO2015149077 | 10/2015 |
| WO | WO2015168379 | 11/2015 |
| WO | WO2015184207 | 12/2015 |
| WO | WO2015195163 | 12/2015 |
| WO | WO2016004060 | 1/2016 |
| WO | WO2016014984 | 1/2016 |
| WO | WO2016028672 | 2/2016 |
| WO | WO2016028896 | 2/2016 |
| WO | WO2016079050 | 5/2016 |
| WO | WO2016086186 | 6/2016 |
| WO | WO2016086189 | 6/2016 |
| WO | WO2016086196 | 6/2016 |
| WO | WO2016095642 | 6/2016 |
| WO | WO2016105450 | 6/2016 |
| WO | WO2016106159 | 6/2016 |
| WO | WO2016110584 | 7/2016 |
| WO | WO2016115274 | 7/2016 |
| WO | WO2016120789 | 8/2016 |
| WO | WO2016141387 | 9/2016 |
| WO | WO2016142314 | 9/2016 |
| WO | WO2016182751 | 11/2016 |
| WO | WO2017019846 | 2/2017 |
| WO | WO2017112775 | 6/2017 |
| WO | WO2017210443 | 12/2017 |
| WO | WO2017210485 | 12/2017 |
| WO | WO2017214092 | 12/2017 |
| WO | WO2018007919 A1 | 1/2018 |
| WO | WO2018041838 | 3/2018 |
| WO | WO2018071918 | 4/2018 |
| WO | WO2018071919 | 4/2018 |
| WO | WO2018091661 | 5/2018 |
| WO | WO2019006472 | 1/2019 |
| WO | WO2019050521 | 3/2019 |
| WO | WO2019204592 | 10/2019 |
| WO | WO2019204665 | 10/2019 |
| WO | WO2020077276 | 4/2020 |

OTHER PUBLICATIONS

"Polythene Glycol and Derivatives for Advanced PEGylation", Catalog 2005-2006, Nektar Therapeutics.
"Xencor Provides Data Updates on XmaB Bispecific Antibody Program and Announces Presentations at Upcoming American Society of Hematology 2014 Annual Meeting", Nov. 6, 2014, XP055255549, retrieved from the internet: http://files.shareholder.com/downloads/AMDA-2B2V8N/0x0x792404/77590b72-837a-4085-bc55-78fa500638dc/XNCR_News_2014_11_6_General_Releases.pdf.
Abbott Laboratories, Strategies and Current Approaches for Improving Drug-Like-Properties During Biologies Drug Candidate Selection, AAPS Webinar-Nov. 10, 2011.
Adams, et al., Avidity-Mediated Enhancement of In vivo Tumor Targeting by Single-Chain Fv Dimers, Clin Cancer Res, 2006, vol. 12(5), pp. 1599-1605, doi: 10.1158/1078-0432.CCR-05-2217.
Alberola-lla et al., Stimulation Through the TCR/CD3 Complex Up-Regulates the CD2 Srface Expression on Human T Lymphocytes, Feb. 15, 1991.
Alibaud et al., A New Monoclonal Anti-CD3? Antibody Reactive on Paraffin Sections, Journal of Histochemistry & Cytochemistry, 2000, vol. 48, p. 1609.
An, et al., IgG2m4, an engineered antibody isotype with reduced Fc function, mAbs, 2009, vol. 1, Issue 6, pp. 572-579, www.landesbioscience.com/journals/mabs/article/10185.

Aplin et al., , Preparation, properties, and applications of carbohydrate conjugates of proteins and lipids, 1981, CRC Crit. Rev. Biochem., pp. 259-306.
Arnett, et al., Crystal structure of a human CD3-ε/δ dimer in complex with a UCHT1 single-chain antibody fragment, PNAS, 2004, vol. 101, No. 46, p. 16268-16273.
Asano, et al., Cytotoxic enhancement of a bispecific diabody (Db) by format conversion to tandem single-chain variable fragment (taFv): The Case of the hEx3 Diabody, JBC Papers in Press, 2010, http://www.jbc.org/cgi/doi/10.1074/jbc.M110.172957.
Asano, et al., Highly Effective Recombinant Format of a Humanized IgG-like Bispecific Antibody for Cancer Immunotherapy with Retargeting of Lymphocytes to Tumor Cells, The Journal of Biological Chemistry, 2007, vol. 282, No. 38, pp. 27659-27665.
Atwell, et al., Stable Heterodimers from Remodeling the Domain Interface of a Homodimer using a Phage Display Library, J. Mol. Biol., 1997, vol. 270, pp. 26-35.
Baca et al., Antibody humanization using monovalent phage display, 1997, J. Biol. Chem. 272(16):10678-10684.
Baeuerle, et al., Response to Letter, "Correct TandAb protein," Molecular Immunology, 2007, vol. 44, p. 3084.
Baeuerle, et al., Review—Bispecific T-Cell Engaging Antibodies for Cancer Therapy, Cancer Res, 2009, vol. 69: (12), pp. 4941-4944.
Barbas, et al. In vitro evolution of a neutralizing human antibody to human immunodeficiency virus type 1 to enhance affinity and broaden strain cross-reactivity, 1994, Proc. Nat. Acad. Sci, USA 91:3809-3813.
Bargou et al., Tumor Regression in Cancer Patients by Very Low Doses of a T Cell-Engaging Antibody, Science, 2008, vol. 321, pp. 974-977.
Bernett et al., Multiple Bispecific Checkpoint Combinations Promote T cell activation., Nov. 11, 2016, retrieved from the internet: http://files.shareholder.com/downloads/AMDA-2B2V8N/0x0x916283/67AE1A8B-40E8-4316-9F79-384D06B2C395/XNCR_SITC_2016_PD1xCTLA4_Poster126_12Nov2016.pdf.
Bhatt, Sea Lane—DDD presentation, "Surrobodies™ - A Novel Approach to Bispecifics . . . ," Aug. 8, 2012.
Bibollet-Ruche et al., The Quality of Chimpanzee T-Cell Activation and Simian Immunodeficiency Virus/Human Immunodeficiency Virus Susceptibility Achieved via Antibody-Mediated T-Cell Receptor/CD3 Stimulation Is a Function of the Anti-CD3 Antibody Isotype, Jul. 30, 2008.
Biochemica, Your apoptosis specialist, 1999, No. 2, pp. 34-37 (Roche Molecular Biochemicals).
Bird et al., Single-chain antigen-binding proteins, 1988, Science 242:423-426.
Bluemel, et al., Epitope distance to the target cell membrane and antigen size determine the potency of T cell-mediated lysis by BiTE antibodies specific for a large melanoma surface antigen, Cancer Immunol Immunother, 2010, vol. 59(8), pp. 1197-1209.
Borras, et al., Generic Approach for the Generation of Stable Humanized Single-chain Fv Fragments from Rabbit Monoclonal Antibodies, The Journal of Biological Chemistry, 2010, vol. 285, No. 12, pp. 9054-9066.
Bortoletto, Nicola et al., "Optimizing anti-CD3 affinity for effective T cell targeting against tumor cells.", Eur J Immunol. Nov. 2002;32(11):3102-7.
Cemerski, et al., Suppression of mast cell degranulation through a dualtargeting tandem IgE-IgG Fc domain biologic engineered to bind with high affinity to FcγRIIb., Immunol Lett. Mar. 30, 2012;143(1):34-43. doi: 10.1016/j.imlet.2012.01.008. Epub Jan. 25, 2012.
Chames et al., Bispecific antibodies for cancer therapy—The light at the end of the tunnel?, mAbs, 2009, vol. 1, Issue 6, pp. 1-9.
Chang, et al., Monoclonal antibodies against oxidized low-density lipoprotein bind to apoptotic cells and inhibit their phagocytosis by elicited macrophages: evidence that oxidation-specific epitopes mediate macrophage recognition., Proc Natl Acad Sci U S A. May 25, 1999;96(11):6353-8.
Chari et al., Immunoconjugates containing novel maytansinoids: promising anticancer drugs, 1992, Cancer Research 52: 127-131.
Chatal, 1989, Monoclonal Antibodies in Immunoscintigraphy, CRC Press (Book Abstract).

(56) References Cited

OTHER PUBLICATIONS

Chelius, et al., Structural and functional characterization of the trifunctional antibody catumaxomab, mAbs, 2010, vol. 2, Issue 3, pp. 309-319.

Chichili et al., A CD3xCD123 bispecific DART for redirecting host T cells to myelogenous leukemia: preclinical activity and safety in nonhuman primates., Sci Transl Med. May 27, 2015;7(289):289ra82. doi: 10.1126/scitranslmed.aaa5693.

Chichili et al., Co-targeting of PD-1 and CTLA-4 Inhibitory Pathways with Bispecific DART® and TRIDENT™ Molecules., Apr. 4, 2017, retrieved from the internet: http://files.shareholder.com/downloads/AMDA-278VRP/0x0x935572/8CC86417-40BA-41C0-935D-EF1B7DB0B5BB/AACR_2017_-_Co-targeting_PD-1_and_CTLA-4_lnhibitory_Pathways_with_DART_and_TRIDENT_Molecules.pdf.

Chothia et al., Canonical structures for the hypervariable regions of immunoglobulins, 1987, J. Mol. Biol. 196:901-917.

Chothia, et al., Structural Determinants in the Sequences of Immunoglobulin Variable Domain, J. Mol. Biol., 1998, vol. 278, pp. 457-479.

Chu et al., Immunotherapy with Long-Lived Anti-CD123 x Anti-CD3 Bispecific Antibodies Stimulates Potent T Cell Mediated Killing of Human AML Cell Lines and of CD123+ Cells In Monkeys: A Potential Therapy for Acute Myelogenous Leukemia, Blood 2014, 124:2316.

Chu et al., Immunotherapy with Long-Lived Anti-CD123 x Anti-CD3 Bispecific Antibodies Stimulates Potent T Cell-Mediated Killing of Human B Cell Lines and of Circulating and Lymphoid B Cells in Monkeys: A Potential Therapy for B Cell Lymphomas and Leukemias, Blood 2014, 124:3111.

Chu et al., Inhibition of B cell receptor-mediated activation of primary human B cells by coengagement of CD19 and FcgammaRIIb with Fc-engineered antibodies., Mol Immunol. Sep. 2008;45(15):3926-33. doi: 10.1016/j.molimm.2008.06.027. Epub Aug. 8, 2008.

Chu et al., Reduction of total IgE by targeted coengagement of IgE B-cell receptor and FcγRIIb with Fc-engineered antibody., J Allergy Clin Immunol. Apr. 2012;129(4):1102-15. doi: 10.1016/j.jaci.2011.11.029. Epub Jan. 16, 2012.

Conrad, et al., TCR and CD3 Antibody Cross-Reactivity in 44 Species, Cytometry Part A, 2007, vol. 71A, pp. 925-933.

Conrath, et al., Antigen Binding and Solubility Effects upon the Veneering of a Camel VHH in Framework-2 to Mimic a VH, J. Mol. Biol. , 2005, vol. 350, pp. 112-125.

Counterman et al., "Volumes of Individual Amino Acid Residues in Gas-Phase Peptide Ions.", J. Am. Chem. Soc., 1999, 121 (16), pp. 4031-4039.

Cuesta, et al., Multivalent antibodies: when design surpasses evolution, Trends in Biotechnology, 2010, vol. 28, No. 7, pp. 355-362, doi:10.1016/j.tibtech.2010.03.007.

D'Argouges, et al., Combination of rituximab with blinatumomab (MT103/MEDI-538), a T cell-engaging CD19-/CD3-bispecific antibody, for highly efficient lysis of human B lymphoma cells, Leukemia Research, 2009, vol. 33, pp. 465-473.

Davies et al., Expression of GnTIII in recombinant anti-CD20 CHO production cell line: expression of antibodies with altered glycoforms leads to an increase in ADCC through higher affinity for FCγRIII, 2001, Biotechnol Bioeng 74:288-294.

Davila, et al., Efficacy and Toxicity Management of 19-28z CAR T Cell Therapy in B Cell Acute Lymphoblastic Leukemia, Sci. Transl. Med., 2014, vol. 6, Issue 224, pp. 1-10, 224ra25.

Davis, et al., SEEDbodies: fusion proteins based on strand-exchange engineered domain (SEED) $C_H3$ heterodimers in an Fc analogue platform for asymmetric binders or immunofusions and bispecific antibodies, Protein Engineering, Design & Selection, 2010, vol. 23, No. 4 pp. 195-202.

De Groot et al., De-lmmunization Of Therapeutic Proteins By T-Cell Epitope Modification, 2005, Dev. In Biologicals, 2005, 122:171-194.

De Pascalis et al., Grafting of "abbreviated" complementarity-determining regions containing specificity-determining residues essential for ligand contact to engineer a less immunogenic humanized monoclonal antibody, 2002, J. Immunol. 169:3076-3084.

Del Nagro et al., A critical role for complement C3d and the B cell.Coreceptor (CD19/CD21) complex in the initiation of inflammatory arthritis., J.Immunol. Oct. 15, 2005:175(8):5379-89.

Demarest et al., Antibody therapeutics, antibody engineering, and the merits of protein stability, Current Opinin in Drug Discovery & Development, 2008 11(5): 675-587, Sep. 11, 2008.

Deyev, et al., Multivalency: the hallmark of antibodies used for optimization of tumor targeting by design, BioEssays, 2008, vol. 30, pp. 904-918.

DiGiammarino et al., Ligand association rates to the inner-variable-domain of a dual-variable-domain immunoglobulin are significantly impacted by linker design, mAbs3:5, 1-8; Sep-Oct; 3(5):487-94, Landes Bioscience, Sep. 1, 2011.

DiGiandomenico et al., A multifunctiorial bispecific antibody protects against *Pseudomonas aeruginosa*., Sci Transl Med. Nov. 12, 2014;6(262):262ra155. doi: 10.1126/scitransimed.3009655.

Dixon, et al., Activation of Human T Lymphocytes by Crosslinking of Anti-CD3 Monoclonal Antibodies, Journal of Leukocyte Biology, 1989, vol. 46, pp. 214-220.

Dong et al., A stable IgG-like bispecific antibody targeting the epidermal growth factor receptor and the type I insulin-like growth factor receptor demonstrates superior anti-tumor activity, mAbs 3:3, May-Jun. 2011: 273-288, May 1, 2011.

Doronina , Development of potent monoclonal antibody auristatin conjugates for cancer therapy, 2003, Nat Biotechnol 21(7):778-784.

Dreier, et al., Extremely Potent, Rapid and Costimulation-lndependent Cytotoxic T-cell Response Against Lymphoma Cells Catalyzed by a Single-Chain Bispecific Antibody, Int. J. Cancer, 2002, vol. 100, pp. 690-697.

Dreier, et al., T Cell Costimulus-lndependent and Very Efficacious Inhibition of Tumor Growth in Mice Bearing Subcutaneous or Leukemic Human B Cell Lymphoma Xenografts by a CD19-/CD3-Bispecific Single-Chain Antibody Construct, The Journal of Immunology, 2003, vol. 170, pp. 4397-4402.

Dubowchik et al., Receptor-mediated and enzyme-dependent targeting of cytotoxic anticancer drugs, 1999, Pharm. Therapeutics 83:67-123.

Ducry et al., Antibody-drug conjugates: linking cytotoxic payloads to monoclonal antibodies, 2010, Bioconjugate Chem. 21:5-13.

Dudgeon, et al., General strategy for the generation of human antibody variable domains with increased aggregation resistance, PNAS Early Edition, 2012, pp. 10879-10884, www.pnas.org/cgi/doi/10.1073/pnas.1202866109 & Supporting Information.

Duke, et al., Measurement of apoptosis and other forms of cell death, 2004, Curr protocols immunol. 3.17.1-3.17.16.

DukSin et al., Relationship of the structure and biological activity of the natural homologues of tunicamycin, 1982, J. Biol. Chem. 257:3105.

Duval, et al., A Bispecific Antibody Composed of a Nonneutralizing Antibody to the gp41 Immunodominant Region and an Anti-CD89 Antibody Directs Broad Human Immunodeficiency Virus Destruction by Neutrophils, Journal of Virology, 2008, pp. 4671-4674, doi:10.1128/JVI.02499-07.

Edge et al., Deglycosylation of glycoproteins by trifluoromethanesulfonic acid, 1981, Anal. Biochem. 118:131.

Elliott, et al., Antiparallel Conformation of Knob and Hole Aglycosylated Half-Antibody Homodimers Is Mediated by a CH2-CH3 Hydrophobic Interaction, Journal of Molecular Biology, 2014, vol. 426, Issue 9, pp. 1947-1957.

Feldmann et al., Novel Humanized and Highly Efficient Bispecific Antibodies Mediate Killing of Prostate Stem Cell Antigen-Expressing Tumor Cells by CD8+ and CD4+ T cells, Aug. 8, 2012.

Feldmann et al., Retargeting of T Cells to Prostate Stem Cell Antigen Expressing Tumor Cells: Comparison of Different Antibody Formats, Dec. 28, 2010.

Fernandes, et al., T Cell Receptors are Structures Capable of Initiating Signaling in the Absence of Large Conformational Rearrangements, The Journal of Biological Chemistry, 2012, vol. 287, No. 16, pp. 13324-13335.

(56) References Cited

OTHER PUBLICATIONS

Fischer, Nicolas et al., "Bispecifc antibodies: molecules that enable novel therapeutic strategies", 2007, vol. 74, pp. 3-14.
Foreman, et al., ErbB3 Inhibitory Surrobodies Inhibit Tumor Cell Proliferation In Vitro and In Vivo, Mol Cancer Ther, 2012, vol. 11(7), pp. 1411-1420.
Foreman, et al., PEGS poster, "ErbB3 Inhibitory Surrobodies Inhibit Tumor Cell Proliferation In Vitro and In Vivo," 2012.
Fraker et al., Crystal structure of peptide cyclo-(D-VAL-L-PRO-L-VAL-D-PRO)$_3$,1978, Biochem. Biophys. Res. Commun. 80(4):849-57.
Francois, et al., Construction of a Bispecific Antibody Reacting with the α-and β-Chains of the Human IL-2 Receptor, The Journal of Immunology, May 15, 1993, vol. 150, No. 10, pp. 4610-4619.
F-star Modular Antibodies Fact Sheet, Apr. 2008, "Modular Antibody Technology" (w/ reference to Ruker WO 2006/072620 A1).
F-star Modular Antibodies Press Release, Mar. 28, 2008, "Antibody Engineering Company F-Star Buys Back Royalty Obligations. TVM Capital Joins Investor Syndicate.".
Haagen, et al., The Efficacy of CD3 x CD19 Bispecific Monoclonal Antibody (BsAb) in a Clonogenic Assay: The Effect of Repeated Addition of BsAb, and Interleukin-2, Blood, 1995, vol. 85, No. 11, pp. 3208-3212.
Hakimuddin et al., A chemical method for the deglycosylation of proteins, 1987, Arch. Biochem. Biophys. 259:52.
Hamel, et al., The Role of the $V_L$- and $V_H$- Segments in the Preferential Reassociation of Immunoglobulin Subunits, Molecular Immunology, 1986, vol. 23, No. 5, pp. 503-510.
Hawkins et al., Selection of phage antibodies by binding affinity mimicking affinity maturation, 1992, J. Mol. Biol. 226:889-896.
Hayden-Ledbetter, et al., CD20-Directed Small Modular Immunopharmaceutical, TRU-015, Depletes Normal and Malignant B Cells, Clin Cancer Res, 2009, vol. 15(8), pp. 2739-2746.
He et al., Humanization and pharmacokinetics of a monoclonal antibody with specificity for both E- and P-selectin, 1998, J. Immunol. 160:1029-1035.
Hedvat et al., Dual Blockade of PD-1 and CTLA-4 with Bispecific Antibodies Promotes Human T cell Activation and Proliferation., Nov. 11, 2016, retrieved from the internet: http://files.shareholder.com/downloads/AMDA-2B2V8N/0x0x916284/D8084990-61EC-4DFE-8B76-60CF58B8C06F/CPI_bispecifics.pdf.
Hennecke et al., "Non-repetitive single-chain Fv linkers selected by selectively infective phage (SIP) technology.", Protein Eng. May 1998;11(5):405-10.
Hernandez-Caselles, et al., A study of CD33 (SIGLEC-3) antigen expression and function on activated human T and NK cells: two isoforms of CD33 are generated by alternative splicing, J. Leukoc. Biol., 2006, vol. 79, pp. 46-58.
Hexham, et al., Influence of relative binding affinity on efficacy in a panel of anti-CD3 scFv immunotoxins, Molecular Immunology, 2001, vol. 38, pp. 397-408.
Hinman et al., Preparation and characterization of monoclonal antibody conjugates of the calicheamicins: a novel and potent family of antitumor antibodies, 1993 Cancer Res. 53:3336-3342.
Hoffmann, et al., Serial killing of tumor cells by cytotoxic T cells redirected with a CD19-/CD3-bispecific single-chain antibody construct, Int. J. Cancer, 2005, vol. 115, pp. 98-104.
Holliger et al., "Diabodies": Small Bivalent and bispecific antibody fragments, 1993, Proc. Natl. Acad. Sci. U.S.A. 90:6444-6448.
Holliger et al., Engineering bispecific antibodies, 1993, Current Opinion Biotechnol. 4:446-449.
Houtenbos, et al., The novel bispecific diabody αCD40/αCD28 strengthens leukaemic dendritic cell-induced T-cell reactivity, British Journal of Haematology, 2008, vol. 142, pp. 273-283.
Hu et al., Minibody: A novel engineered anti-carcinoembryonic antigen antibody fragment (single-chain Fv-$C_H$3) which exhibits rapid, high-level targeting of xenografts, 1996, Cancer Res. 56:3055-3061.
Huston et al., Protein engineering antibody binding sites: recovery of specific activity in an anti-digoxin single-chain Fv analogue produced in *Escherichia coli*, 1988, Proc. Natl. Acad. Sci. U.S.A. 85:5879-5883.
Johnson et al., Anti-tumor activity of CC49-doxorubicin immunoconguates, 1995, Anticancer Res. 15:1387-93.
Johnson, et al., Effector Cell Recruitment with Novel Fv-based Dual-affinity Re-targeting Protein Leads to Potent Tumor Cytolysis and in Vivo B-cell Depletion, J. Mol. Biol., 2010, vol. 399, pp. 436-449.
Jones et al., Replacing the complementarity-determining regions in a human antibody with those from a mouse, 1986, Nature 321:522-525.
Jordan et al., Structural understanding of stabilization patterns in engineered bispecific Ig-like antibody molecules, Proteins 2009; 77:832-841, Jun. 19, 2009.
Jung, et al., Design of interchain disulfide bonds in the framework region of the Fv fragment of the monoclonal antibody B3, Proteins, 1994, vol. 19(1), pp. 35-47.
Jung, et al., Target Cell-restricted Triggering of the CD95 (APO-1/Fas) Death Receptor with Bispecific Antibody Fragments, Cancer Research, 2001, vol. 61, pp. 1846-1848.
Jungbluth et al., A monoclonal antibody recognizing human cancers with amplification/overexpression of the human epidermal growth factor receptor, 2003, Proc Natl Acad Sci U S A. 100(2):639-44.
Kabat et al., 1991, Sequences of proteins of immunological interest, Department of Health and Human Services, Bethesda, vol. 1, 5$^{th}$ Ed.
Kakutani et al., Accumulation of LOX-1 ligand in plasma and atherosclerotic lesions of Watanabe heritable hyperlipidemic rabbits: identification by a novel enzyme immunoassay.,Biochem Biophys Res Commun. Mar. 23, 2001;282(1):180-5.
Kanakaraj, et al., Simultaneous targeting of TNF and Ang2 with a novel bispecific antibody enhances efficacy in an in vivo model of arthritis, mAbs, 2012, vol. 4, Issue 5, pp. 600-613, http://dx.doi.org/10.4161/mabs.21227 & Supplemental Data.
Kettleborough et al., Humanization of a mouse monoclonal antibody by CDR-grafting: the importance of framework residues on loop conformation, 1991, Protein Eng. 4(7):773-83.
Keyna, et al., Surrogate Light Chain-Dependent Selection of Ig Heavy Chain V Regions, J. Immunol., 1995, vol. 155, pp. 5536-5542.
Kharmate et al., Inhibition of tumor promoting signals by activation of SSTR2 and opioid receptors in human breast cancer cells., Cancer Cell Int. Sep. 23, 2013;13(1):93. doi: 10.1186/1475-2867-13-93.
Kiewe, et al., Phase I Trial of the Trifunctional Anti-HER2 x Anti-CD3 Antibody Ertumaxomab in Metastatic Breast Cancer, Clin Cancer Res., 2006, vol. 12(10), pp. 3085-3091.
Kim et al., "Localization of the site of murine IgG1 molecule that is involved in binding the murine intestinal Fc receptor," Eur. J. Immunol., 24:2429-2434, 1994.
Kim et al., Mutational approaches to improve the biophysical properties of human single-domain antibodies., Biochim Biophys Acta. Nov. 2014;1844(11):1983-2001. doi: 10.1016/j.bbapap.2014.07.008. Epub Jul. 24, 2014.
Kipriyanov, et al., Bispecific CD3 x CD19 Diabody for T Cell-Mediated Lysis of Malignant Human B Cells, Int. J. Cancer, 1998. vol. 77, pp. 763-772.
Kipriyanov, et al., Bispecific Tandem Diabody for Tumor Therapy with Improved Antigen Binding and Pharmacokinetics, J. Mol. Biol., 1999, vol. 293, pp. 41-56.
Kipriyanov, et al., Effect of Domain Order on the Activity of Bacterially Produced Bispecific Single-chain Fv Antibodies, J. Mol. Biol., 2003, vol. 330, pp. 99-111.
Kipriyanov, et al., Two amino acid mutations in an anti-human CD3 single chain Fv antibody fragment that affect the yield on bacterial secretion but not the affinity, Protein Engineering, 1997, vol. 10, No. 4, pp. 445-453.
Klein et al., Progression of metastatic human prostate cancer to androgen independence in immunodeficient SDIC mice, 1997, Nature Medicine 3: 402-408.

(56) References Cited

OTHER PUBLICATIONS

Klinger, et al., Immunopharmacologic response of patients with B-lineage acute lymphoblastic leukemia to continuous infusion of T cell-engaging CD19/CD3-bispecific BiTE antibody blinatumomab, Blood, 2012, vol. 119, No. 26, pp. 6226-6233.
Koristka, et al., Retargeting of Human Regulatory T Cells by Single-Chain Bispecific Antibodies, The Journal of Immunology, 2012, vol. 188, pp. 1551-1558, www.jimmunol.org/cgi/doi/10.4049/jimmunol.1101760.
Kostelny, et al., Formation of a Bispecific Antibody by the Use of Leucine Zippers, The Journal of Immunology 1992, vol. 148, pp. 1547-1553.
Krah et al., "Single-domain antibodies for biomedical applications.", Immunopharmacol Immunotoxicol. 2016;38(1):21-8. doi: 10.3109/08923973.2015.1102934. Epub Nov. 9, 2015.
Krauss et al., Specificity grafting of human antibody frameworks selected from a phage display library: generation of a highly stable humanized anti-CD22 single-chain Fv fragment, 2003, Protein Engineering 16(10):753-759.
Krupka, et al., CD33 target validation and sustained depletion of AML blasts in long-term cultures by the bispecific T-cell-engaging antibody AMG 330, Blood, 2014, vol. 123, No. 3, pp. 356-365, Prepublished online Dec. 3, 2013; doi:10.1182/blood-2013-08-523548 & Data Supplement.
Kung, et al., Monoclonal Antibodies Defining Distinctive Human T Cell Surface Antigens, Science, 1979, vol. 206, pp. 347-349.
Kuppen, peter et al., The development and purification of a bispecific antibody for lymphokine-activated killer cell targeting against the rat colon carcinoma CC531., Cancer Immunol Immunother. Jun. 1993;36(6):403-8.
Laszlo et al., Cellular determinants for preclinical activity of a novel CD33/CD3 bispecific T-cell engager (BiTE) antibody, AMG 330, against human AML, blood 2014 123: 554-561, Dec. 5, 2013.
Lau et al., Conjugation of Doxorubicin to monoclonal anti-carcinoembryonic antigen antibody via novel thiol-directed cross-linking regents, 1995, Bioorg-Med-Chem. 3(10):1299-1304.
Lau et al., Novel doxorubicin-monoclonal anti-carcinoembryonic antigen antibody immunoconjugate activity in vitro, 1995, Bioorg-Med-Chem. 3(10):1305-12.
Lazar Declaration, Dec. 27, 2010, pp. 1-4.
Lewis, et al., Generation of bispecific IgG antibodies by structure-based design of an orthogonal Fab interface, Nature Biotechnology, 2014, doi:10.1038/nbt.2797 & Supplemental Information.
Li, et al., Construction and characterization of a humanized anti-human CD3 monoclonal antibody 12F6 with effective immunoregulation functions, Immunology, 2005, vol. 116, pp. 487-498.
Lindhofer, et al., Preferential Species-Restricted Heavy/Light Chain Pairing in Rat/Mouse Quadromas: Implications for a Single-Step Purification of Bispecific Antibodies, The Journal of Immunology, 1995, vol. 155, pp. 219-225.
Ling, et al., Interspecies Scaling of Therapeutic Monoclonal Antibodies: Initial Look, J Clin Pharmacol, 2009, vol. 49, pp. 1382-1402, doi: 10.1177/0091270009337134.
Link, et al., Production and Characterization of a Bispecific IgG Capable of Inducing T-Cell-Mediated Lysis of Malignant B Cells, Blood, 1993, vol. 81, No. 12, pp. 3343-3349.
Linke, et al., Catumaxomab, Clinical development and future directions, mAbs, 2010, vol. 2, Issue 2, pp. 129-136.
Little, et al., Letter to the Editor, "Flawed TandAb production," Molecular Immunology, 2007, vol. 44, p. 3083.
Liu et al., Asymmetrical Fc Engineering Greatly Enhances Antibodydependent Cellular Cytotoxicity (ADCC) Effector Function and Stability of the Modified Antibodies, J. Biol. Chem. 2014, 289: 3571-3590, Dec. 5, 2013.
Liu et al., Eradication of large colon tumor xenografts by targeted delivery of maytansinoids, 1996 Proc. Natl. Acad. Sci. USA 93:8618-8623.
Liu, et al., Crystallization of a Deglycosylated T Cell Receptor (TCR) Complexed with an Anti-TCR Fab Fragment, The Journal of Biological Chemistry, 1996, vol. 271, No. 52, pp. 33639-33646.
Lode et al., Targeted therapy with a novel enediyene antibiotic calicheamicins ol effectively suppress growth and dissemination of liver metastases in a syngeneic model of murine neuroblastoma, 1998, Cancer Res. 58:2928.
Löffler, et al., A recombinant bispecific single-chain antibody, CD19 × CD3, induces rapid, and high lymphoma-directed cytotoxicity by unstimulated T lymphocytes, Blood, 2000, vol. 95, No. 6, pp. 2098-2103.
Lu, et al., A Fully Human Recombinant IgG-like Bispecific Antibody to Both the Epidermal Growth Factor Receptor and the Insulin-like Growth Factor Receptor for Enhanced Antitumor Activity, The Journal of Biological Chemistry, 2005, vol. 280, No. 20, pp. 19665-19672.
Lu, et al., Di-diabody: a novel tetravalent bispecific antibody molecule by design, Journal of Immunological Methods, 2003, vol. 279, pp. 219-232.
Lu, et al., Fab-scFv fusion protein: an efficient approach to production of bispecific antibody fragments, Journal of Immunological Methods, 2002, vol. 267, pp. 213-226.
Lu, et al., The effect of variable domain orientation and arrangement on the antigen-binding activity of a recombinant human bispecific diabody, Biochemical and Biophysical Research Communications, 2004, vol. 318, pp. 507-513.
Lum, et al., The new face of bispecific antibodies: targeting cancer and much more, Experimental Hematology, 2006, vol. 34, pp. 1-6.
Lutterbuese, et al., AACR Poster, "Conversion of Cetuximab, Panitumumab, Trastuzumab and Omalizumab into T Cell-engaging BiTE Antibodies Creates Novel Drug Candidates of High Potency," 2008.
Lutterbuese, et al., T cell-engaging BiTE antibodies specific for EGFR potently eliminate KRAS- and BRAF-mutated colorectal cancer cells, PNAS Early Edition, 2010, www.pnas.org/cgi/doi/10.1073/pnas.1000976107 & Supporting Information.
Ma, et al., Expression and Characterization of a Divalent Chimeric Anti-Human CD3 Single Chain Antibody, Scand.J.Immunol, 1996, vol. 43, pp. 134-139.
Mabry, et al., A dual-targeting PDGFRβ/VEGF-A molecule assembled from stable antibody fragments demonstrates anti-angiogenic activity in vitro and in vivo, mAbs, 2010, vol. 2, Issue 1, pp. 20-34; www.landesbioscience.com/journals/mabs/article/10498 & Supplemental Information.
Mabry, et al., Engineering of stable bispecific antibodies targeting IL-17A and IL-23, Protein Engineering, Design & Selection, 2009, vol. 23, No. 3, pp. 115-127; doi:10.1093/protein/gzp073 & Supplementary Figures 1-8.
Mack, et al., A small bispecific antibody construct expressed as a functional single-chain molecule with high tumor cell cytotoxicity, Proc. Natl. Acad. Sci. USA, 1995, vol. 92, pp. 7021-7025.
Mack, et al., Biologic Properties of a Bispecific Single-Chain Antibody Directed Against 17-1A (EpCAM) and CD3—Tumor Cell-Dependent T Cell Stimulation and Cytotoxic Activity, The Journal of Immunology, 1997, vol. 158, pp. 3965-3970.
MacroGenics Factsheet, Dual Affinity Re-Targeting ("DART") Platform, 2010.
Mandler et al., Immunoconjugates of geldanamycin and anti-HER2 Monoclonal antibodies: antiproliferative activity on human breast carcinoma cell lines, 2000, J. Nat. Cancer Inst. 92(19):1573-1581.
Mandler et al., Modifications in synthesis strategy improve the yield and efficacy of geldanamycin-herceptin immunoconjugates, 2002, Bioconjugate Chem. 13:786-791).
Mandler et al., Synthesis and evaluation of antiproliferative activity of a geldanaymcin-herceptin™ immunoconjugates, 2000, Bioorganic& Med. Chem. Letters 10:1025-1028.
Mandy, et al., Effect of Reduction of Several Disulfide Bonds on the Properties and Recombination of Univalent Fragments of Rabbit Antibody, The Journal of Biological Chemistry, 1963, vol. 238, No. 1, pp. 206-213.
Mandy, et al., Recombination of Univalent Subunits Derived from Rabbit Antibody, The Journal of Biological Chemistry, 1961, vol. 236, No. 12, pp. 3221-3226.
Marks et al., By-passing immunization: building high affinity human antibodies by chain shuffling, 1992, Biotechnology 10:779-783.

(56) References Cited

OTHER PUBLICATIONS

Martin, et al., Generation of the Germline Peripheral B Cell Repertoire: VH81X-λ B Cells Are Unable to Complete All Developmental Programs, J. Immunol., 1998, vol. 160, pp. 3748-3758.
Martinez, et al., Characterization of a novel modification on lgG2 light chain: Evidence for the presence of O-linked mannosylation, J. Chromatogr. A, 2007, vol. 1156 pp. 183-187.
Marvin, Bispecific antibodies for dual-modality cancer therapy: killing two signaling cascades with one stone, Curr Opin Drug Discov Devel, 2006, vol. 9(2), pp. 184-193.
Marvin, et al., Recombinant approaches to IgG-like bispecific antibodies, Acta Pharmacologica Sinica, 2005, vol. 26 (6), pp. 649-658.
Mateo et al., Humanization of a mouse nonoclonal antibody that blocks the epidermal growth factor receptor: recovery of antagonistic activity, 1997, Immunotechnology, 3(1):71-81.
McPhee, Engineering human immunodeficiency virus 1 protease heterodimers as macromolecular inhibitors of viral maturation, Proc. Natl. Acad. Sci. USA, 1996, vol. 93, pp. 11477-11481.
Meijer, et al., Isolation of Human Antibody Repertoires with Preservation of the Natural Heavy and Light Chain Pairing, J. Mol. Biol., 2006, vol. 358, pp. 764-772.
Mertens, Nico, "Tribodies: Fab-scFv fusion proteins as a platform to create multi-functional pharmaceuticals.", SpringerLink 2011, 135-149.
Metz, et al., Bispecific antibody derivatives with restricted binding functionalities that are activated by proteolytic processing, Protein Engineering, Design & Selection, 2012, vol. 25, No. 10, pp. 571-580.
Metz, et al., Bispecific digoxigenin-binding antibodies for targeted payload delivery, PNAS, 2011, vol. 108, No. 20, pp. 8194-8199.
Michaelson et al., Anti-tumor activity of stability-engineered IgG-like bispecific antibodies targeting TRAIL-R2 and LTbetaR, [mAbs 1:2, 128-141; Mar./Apr. 2009]; Mar. 11, 2009.
Michalk et al., Characterization of a novel single-chain bispecific antibody for retargeting of T cells to tumor cells via the TCR co-receptor CD8., PLoS One. Apr. 21, 2014;9(4):e95517. doi: 10.1371/journal.pone.0095517.
Miller et al., Stability engineering of scFvs for the development of bispecific and multivalent antibodies, PEDS, 2010, vol. 23, No. 7, pp. 549-557 & Supplementary Data.
Miller, biogen idee Stability Engineering and Production of IgG-like Bispecifc Antibodies, AAPS National Biotechnology Conference, Jun. 24 to Jun. 27, 2007.
Mimoto et al., Engineered antibody Fc variant with selectively enhanced FcγRIIb binding over both FcγRIIa(R131) and FcγRIIa(H131)., Protein Eng Des Sel. Oct. 2013;26(10):589-98. doi: 10.1093/protein/gzt022. Epub Jun. 5, 2013.
Mimoto, et al., Novel asymmetrically engineered antibody Fc variant with superior FcγR binding affinity and specificity compared with afucosylated Fc variant, mAbs, 2013, vol. 5, Issue 2, pp. 229-236.
Modjtahedi et al, Phase I trial and tumour localization of the anti-EGFR monoclonal antibody ICR62 in head and neck or lung cancer, 1996, Br J Cancer, 73(2):228-35.
Modjtahedi et al., Targeting of cells expressing wild-type EGFR and type-III mutant EGFR (EGFRVIII) by anti-EGFR MaB ICR62: a two-pronged attack for tumor therapy, 2003, Int J Cancer, 105(2):273-80.
Modjtahedi et al., Antitumor activity of combinations of antibodies directed against different epitopes on the extracellular domain of the human EGF receptor, 1993, J. Cell Biophys. 1993, 22(1-3):129-46.
Modjtahedi et al., The human EGF receptor as a target for cancer therapy: six new rat mAbs against the receptor on the breast carcinoma MDA-MB 468, 1993, Br J Cancer. 1993, 67(2):247-53.
Mølhøj, et al., CD19-/CD3-bispecific antibody of the BiTE class is far superior to tandem diabody with respect to redirected tumor cell lysis, Molecular Immunology 2007, vol. 44 , pp. 1935-1943.

Moore et al., Tuning T Cell Affinity Improves Efficacy and Safety of Anti-CD38 × Anti-CD3 Bispecific Antibodies in Monkeys—a Potential Therapy for Multiple Myeloma., 57th ASH Annual Meeting and Exposition (Dec. 5-8, 2015), American Society of Hematology, Orlando, Florida.
Moore, et al., A novel bispecific antibody format enables simultaneous bivalent and monovalent co-engagement of distinct target antigens., MAbs. Nov. 2011-Dec.; 3(6): 546-557; Published online Nov. 1, 2011. doi: 10.4161/mabs.3.6.18123.
Moore, et al., Application of dual affinity retargeting molecules to achieve optimal redirected T-cell killing of B-cell lymphoma, Blood, 2011, vol. 117, No. 17, pp. 4542-4551.
Moretti et al., BEAT® the bispecific challenge: a novel and efficient platform for the expression of bispecific IgGs. BMC Proceedings 2013 7(Suppl 6):O9.
Morrison, et al., News and Views: Two heads are better than one, Nature Biotechnology, 2007, vol. 25, No. 11, pp. 1233-1234.
Mosmann, 1983, Rapid colorimetric assay for cellular growth and survival: application to proliferation and cytotoxicity assays, J. Immunol. Methods 65:55-63.
Muda, et al., Therapeutic assessment of SEED: a new engineered antibody platform designed to generate mono and bispecific antibodies, Protein Engineering, Design & Selection, 2011, vol. 24, No. 5, pp. 447-454.
Muramatsu et al., Production and characterization of an active single-chain variable fragment antibody recognizing CD25., Cancer Lett. Jul. 28, 2005;225(2):225-36. Epub Jan. 23, 2005.
Murthy et al., Binding of an antagonistic monoclonal antibody to an intact and fragmented EGF-receptor polypeptide, 1987, Arch Biochem Biophys. 252(2):549-60.
Nagorsen, et al., Blinatumomab: A historical perspective, Pharmacology & Therapeutics, 2012, vol. 136, pp. 334-342, http://dx.doi.org/10.1016/j.pharmthera.2012.07.013.
Nelson, et al., Point of View: Antibody fragments—Hope and hype, mAbs, 2010, vol. 2, Issue 1, pp. 77-83.
Neville et al., Enhancement of immunotoxin efficacy by acid-cleavable cross-ling agents utilizing diphtheria toxin and toxin mutants, 1989, Biol. Chem. 264:14653-14661.
Nielsen, et al., Human T cells resistant to complement lysis by bivalent antibody can be efficiently lysed by dimers of monovalent antibody, Blood, 2002, vol. 100, No. 12, pp. 4067-4073.
Nisonoff, et al., Letters to the Editors: Recombination of a Mixture of Univalent Antibody Fragments of Different Specificity, Arch. Biochem. Biophys., 1961, pp. 460-462.
Nisonoff, et al., Quantitative Estimation of the Hybridization of Rabbit Antibodies, Nature, 1962, vol. 194, No. 4826, pp. 355-359.
North, et al., A New Clustering of Antibody CDR Loop Conformations, J. Mol. Biol., 2011, vol. 406, pp. 228-256, doi:10.1016/j.jmb.2010.10.030.
O'Connor et al., Humanization of an antibody against human protein C and calcium-dependence involving framework residues, 1998, Protein Eng 11:321-8.
Olafsen, et al., Covalent disulfide-linked anti-CEA diabody allows site-specific conjugation and radiolabeling for tumor targeting applications, Protein Engineering, Design & Selection, 2004, vol. 17, No. 1, pp. 21-27.
Ott et al., CTLA-4 and PD-1/PD-L1 blockade: new immunotherapeutic modalities with durable clinical benefit in melanoma patients., Clin Cancer Res. Oct. 1, 2013;19(19):5300-9. doi: 10.1158/1078-0432.CCR-13-0143.
Page et al., 1993, Intermantional. Journal of Oncology 3:473-476.
Panke, et al., Quantification of cell surface proteins with bispecific antibodies, Protein Engineering, Design & Selection, 2013, vol. 26, No. 10, pp. 645-654.
Pessano, et al., The T3/T cell receptor complex: antigenic distinction between the two 20-kd T3 (T3-δ and T3-∈) subunits, The EMBO Journal, 1985, vol. 4, No. 2, pp. 337-344.
Pettit et al., Antineoplastic agents 365. Dolastatin 10 SAR probes, 1998, Anti-Cancer Drug Design 13:243-277.
Pettit et al., Dolastatins 24. Synthesis of (−)-dolastatin 10.1 X-ray molecular structure of N,N-dimethylvalyl-valyl-dolaisoleuine tert-butyl ester, 1996, J. Chem. Soc. Perkin Trans. 1 5:859-863.

(56) References Cited

OTHER PUBLICATIONS

Pettit et al., Specific activities of dolastatin 10 and peptide derivatives against Cryptococcus neoformans, 1998, Antimicrob. Agents Chemother. 42(11):2961-2965.
Pettit et al., Structure-activity studies with chiral isomers and with segments of the antimitotic marine peptide dolastation 10, 1989, J. Am. Chem. Soc. 111:5463-5465.
Pettit, et al., The dolastatins; 18: Sterospecific synthesis of dolaproinel, 1996, Synthesis 719-725.
Pichler et al., Differences of T-Cell Activation by the Anti-CD3 Antibodies Leu4 and BMA030, Mar. 30, 1987.
Potapov et al., Protein-Protein Recognition: Juxtaposition of Domain and Interface Cores in Immunoglobulins and Other Sandwich-like Proteins, J. Mol. Biol., 2004, vol. 342, pp. 665-679.
Presta et al., Humanization of an anti-vascular endothelial growth factor monoclonal antibody for the therapy of solid tumors and other disorders, 1997, Cancer Res.57(20):4593-9.
Queen et al., A humanized antibody that binds to the interleukin 2 receptor, 1989, Proc Natl Acad Sci, USA 86:10029-33.
Rader et al., A phage display approach for rapid antibody humanization: designed combinatorial V gene libraries, 1998, Proc. Natl. Acad. Sci. USA 95: 8910-8915.
Raghavan et al., Fc receptors and their interactios with immunoglobulins, 1996, Annu Rev Cell Dev Biol 12:181-220.
Rattel, et al., AACR Poster, "Validation of Cynomolgus Monkeys as Relevant Species for Safety Assessment of a Novel Human BiTE Antibody Platform for Cancer Therapy," 2010.
Reddy et al., Elimination of Fc receptor-dependent effector functions of a modified IgG4 monoclonal antibody to human CD4., J Immunol. Feb. 15, 2000;164(4):1925-33.
Reiter et al., Disulfide stabilization of antibody Fv: computer predictions and experimental evaluation, Protein Eng., 1995, vol. 8(12), pp. 1323-1331.
Reiter et al., Engineering interchain disulfide bonds into conserved framework regions of Fv fragments: improved biochemical characteristics of recombinant immunotoxins containing disulfide-stabilized Fv, Protein Eng., 1994, vol. 7(5), pp. 697-704.
Remington's Pharmaceutical Sciences 16th edition, Osol, A. Ed. (1980) (Book Abstract).
Repp, et al., Combined Fc-protein- and Fc-glyco-engineering of scFv-Fc fusion proteins synergistically enhances CD16a binding but does not further enhance NK-cell mediated ADCC, Journal of Immunological Methods, 2011, vol. 373, Issues 1-2, pp. 67-78.
Ridgway, et al., 'Knobs-into-holes' engineering of antibody CH3 domains for heavy chain heterodimerization, Protein Engineering,1996, vol. 9, No. 7, pp. 617-621.
Riechmann et al., Reshaping human antibodies for therapy, 1988, Nature 332:323-329.
Riethmüller, Symmetry breaking: bispecific antibodies, the beginnings, and 50 years on, Cancer Immunity, 2012, vol. 12, p. 12, pp. 1-7.
Rodeck et al., Interactions between growth factor receptors and corresponding monoclonal antibodies in human tumors, 1987, J Cell Biochem. 35(4):315-20.
Roguska et al., Humanization of murine monoclonal antibodies through variable domain resurfacing, 1994, Proc. Natl. Acad. Sci. USA 91:969-973.
Roosnek, et al., Triggering T Cells by Otherwise Inert Hybrid Anti-CD3/Antitumor Antibodies Requires Encounter with the Specific Target Cell, J. Exp. Med., 1989, vol. 170, pp. 297-302.
Roque et al., Antibodies and genetically engineered related molecules: production and purification, 2004, Biotechnol. Prog. 20:639-654.
Rose, et al., Mutation of Y407 in the CH3 domain dramatically alters glycosylation and structure of human IgG, mAbs, 2013, vol. 5, Issue 2, pp. 219-228.
Rose, et al., Quantitative Analysis of the Interaction Strength and Dynamics of Human IgG4 Half Molecules by Native Mass Spectrometry, Structure , 2011, vol. 19, pp. 1274-1282.

Rosok et al., A combinatorial library strategy for the rapid humanization of anticarcinoma BR 96 Fab, 1996, J. Biol. Chem. 271(37): 22611-22618.
Rossi, et al., A new class of bispecific antibodies to redirect T cells for cancer immunotherapy, mAbs 2014, vol. 6, Issue 2, pp. 381-391.
Roux, et al., Structural analysis of the nurse shark (new) antigen receptor (NAR): Molecular convergence of NAR and unusual mammalian immunoglobulins, Proc. Natl. Acad. Sci. USA, 1998, vol. 95, pp. 11804-11809.
Rudnick, et al., Affinity and Avidity in Antibody-Based Tumor Targeting, Cancer Biotherapy and Radiopharmaceuticals, 2009, vol. 24, No. 2, pp. 155-161, doi: 10.1089/cbr.2009.0627.
Röthlisberger, et al., Domain Interactions in the Fab Fragment: A Comparative Evaluation of the Single-chain Fv and Fab Format Engineered with Variable Domains of Different Stability, J. Mol. Biol. , 2005, vol. 347, pp. 773-789.
Salmeron et al., A conformational epitope expressed upon association of CD3-epsilon with either CD3-delta or CD3-gamma is the main target for recognition by anti-CD3 monoclonal antibodies, Nov. 1, 1991.
Sancho et al., CD3- Surface Expression Is Required for CD4-p56ick-mediated Up-regulation of T Cell Antigen Receptor-CD3 Signaling in T Cells, Apr. 16, 1992.
Schaefer, et al., A Two-in-One Antibody against HER3 and EGFR Has Superior Inhibitory Activity Compared with Monospecific Antibodies, Cancer Cell, 2011, vol. 20, pp. 472-486 & Supplemental Information, pp. 1-21.
Schaefer, et al., Immunoglobulin domain crossover as a generic approach for the production of bispecific IgG antibodies, PNAS, 2011, vol. 108, No. 27, pp. 11187-11192.
Schlapschy, et al., Functional humanization of an anti-CD16 Fab fragment: obstacles of switching from murine λ to human λ or κ light chains, Protein Engineering, Design & Selection, 2009, vol. 22, No. 3, pp. 175-188, doi:10.1093/protein/gzn066.
Schlereth, et al., Eradication of Tumors from a Human Colon Cancer Cell Line and from Ovarian Cancer Metastases in Immunodeficient Mice by a Single-Chain Ep-CAM-/CD3-Bispecific Antibody Construct, Cancer Res 2005, vol. 65(7), pp. 2882-2889.
Schlereth, et al., T-cell activation and B-cell depletion in chimpanzees treated with a bispecific anti-CD19/anti-CD3 single-chain antibody construct, Cancer Immunol Immunother, 2006, vol. 55, pp. 503-514, doi:10.1007/s00262-005-0001-1.
Schoonjans, et al., Fab Chains As an Efficient Heterodimerization Scaffold for the Production of Recombinant Bispecific and Trispecific Antibody Derivatives, The Journal of Immunology, 2000, vol. 165, pp. 7050-7057.
Schroder et al., The Peptides, vol. pp 76-136, 1965, Academic Press.
Senter et al., Proceedings of the American Association for Cancer Research, 2004, vol. 45, Abstract No. 623.
Senter, Potent antibody drug conjugates for cancer therapy, 2009, Current Opin. Chem. Biol. 13:235.
Sforzini et al., Targeting of saporin to Hodgkin's lymphoma cells by anti-CD30 and anti-CD25 bispecific antibodies., Br J Haematol. Sep. 1998;102(4):1061-8.
Shalaby, et al., Development of Humanized Bispecific Antibodies Reactive with Cytotoxic Lymphocytes and Tumor Cells Overexpressing the HER2 Protooncogene, J.Exp.Med., 1992, vol. 175, pp. 217-225.
Shan, et al., Characterization of scFv-Ig Constructs Generated from the Anti-CD20 mAb 1F5 Using Linker Peptides of Varying Lengths, J Immunol, 1999, vol. 162, pp. 6589-6595.
Shearman, et al., Construction, Expression and Characterization of Humanized Antibodies Directed Against the Human α/β T Cell Receptor, The Journal of Immunology, 1991, vol. 147, No. 12, pp. 4366-4373.
Shen, et al., Catumaxomab, a rat/murine hybrid trifunctional bispecific monoclonal antibody for the treatment of cancer, Curr Opin Mol Ther, 2008, vol. 10(3), pp. 273-284.
Shen, et al., Single Variable Domain-IgG Fusion: A Novel Recombinant Approach to Fc Domain-Containing Bispecific Antibodies, The Journal of Biological Chemistry, 2006, vol. 281, No. 16, pp. 10706-10714.

(56) References Cited

OTHER PUBLICATIONS

Shields et al., Lack of fucose on human IgG1 N-linked oligosaccharide improves binding to human FcγRIII and antibody-dependent cellular toxicity, 2002, J Biol Chem 277:26733-26740.
Shier et al., Identification of functional and structural amino-acid residues by parsimonious mutagenesis, 1995, Gene 169:147-155.
Shinkawa et al., The absence of fucose but not the presence of galactose or bisecting N-acetylglucosamine of human IgG1 complex-type oligosaccharides shows the critical role of enhancing antibody-dependent cellular cytotoxicity, 2003, J Biol Chem 278:3466-3473.
Skehan et al., Identification of functional and structural amino-acid residues by parsimonious mutagenesis, 1990, J. Natl. Cancer Inst. 82(13):1107-12.
Smith et al., Mouse model recapitulating human Fcγ receptor structural and functional diversity., Proc Natl Acad Sci U S A. Apr. 17, 2012;109(16):6181-6. doi: 10.1073/pnas.1203954109. Epub Apr. 2, 2012.
Soumyarani et al., Oxidatively modified high density lipoprotein promotes inflammatory response in human monocytes-macrophages by enhanced production of ROS, TNF-α, MMP-9, and MMP-2., Mol Cell Biochem. Jul. 2012;366(1-2):277-85. doi: 10.1007/s11010-012-1306-y. Epub Apr. 17, 2012.
Spies et al., Alternative molecular formats and therapeutic applications for bispecific antibodies., Mol Immunol. Jan. 27, 2015. pii: S0161-5890(15)00005-X. doi: 10.1016/j.molimm.2015.01.003.
Spiess, et al., Bispecific antibodies with natural architecture produced by co-culture of bacteria expressing two distinct half-antibodies, Nature Biotechnology, 2013, doi:10.1038/nbt.2621 & Supplemental Information.
Spranger et al., Mechanism of tumor rejection with doublets of CTLA-4, PD-1/PD-L1, or IDO blockade involves restored IL-2 production and proliferation of CD8(+) T cells directly within the tumor microenvironment., J Immunother Cancer. Feb. 18, 2014;2:3. doi: 10.1186/2051-1426-2-3. eCollection 2014.
Stamova, Unexpected recombinations in single chain bispecific anti-CD3-anti-CD33 antibodies can be avoided by a novel linker module, Oct. 29, 2011.
Stanfield, et al., Maturation of Shark Single-domain (IgNAR) Antibodies: Evidence for Induced-fit Binding, J. Mol. Biol., 2007, vol. 367, pp. 358-372.
Stewart, et al., Recombinant CD36 inhibits oxLDL-induced ICAM-1-dependent monocyte adhesion., Mol Immunol. Feb. 2006;43(3):255-67.
Strop, P. et al., Generating Bispecific Human IgG1 and IgG2 Antibodies from Any Antibody Pair, J. Mol. Biol., 2012, doi:10.1016/j.jmb.2012.04.020.
Szymkowski et al., Creating the next generation of protein therapeutics through rational drug design, Current opinion in drug discovery & development, Sep. 1, 2005, p. 590, XP055354917, England.
Tabrizi et al., Biodistribution mechanisms of therapeutic monoclonal antibodies in health and disease., AAPS J. Mar. 2010;12(1):33-43. doi: 10.1208/s12248-009-9157-5. Epub Nov. 19, 2009.
Tan et al., "Superhumanized" antibodies: reduction of immunogenic potential by complementarity-determining region grafting with human germline sequences: application to an anti-CD28, 2002, J. Immunol. 169:1119-1125.
Tan, Philip, Presentation at PepTalk, Jan. 25, 2013, "Bi-specific ADAPTIR Molecule Targeting CD86 and Delivering Monomeric IL10 to Inhibit Antigen Presenting Cells".
Tang et al., Selection of linkers for a catalytic single-chain antibody using phage display technology., Journal of Biological Chemistry, American Society for Biochemistry and Molecular Biology, US, vol. 271, No. 26, Jan. 1, 1996, pp. 15682-19258.
Tarcsa et al, Chapter 10 Dual-Variable Domain Immunoglobulin (DVD-Ig™) Technology: A Versatile, Novel Format for the Next Generation of Dual-Targeting Biologies, Bispecific Antibodies 2011, pp. 171-185, 2011.

Teachey, et al., Cytokine release syndrome after blinatumomab treatment related to abnormal macrophage activation and ameliorated with cytokine-directed therapy, Blood, 2013, vol. 121, No. 26, pp. 5154-5157.
Tedgui, et al., Cytokines in atherosclerosis: pathogenic and regulatory pathways., Physiol Rev. Apr. 2006;86(2):515-81.
Terry M., "FDA Places Clinical Hold on AML Drug Co-Developed by Johnson & Johnson (JNJ) and Genmab A/S (Gen Co.)", Biospace 2016, Retrieved from the internet: https://www.biospace.com/article/fda-places-clinical-hold-on-aml-drug-co-developed-by-johnson-and-johnson-and-genmab-a-s-/.
Thompson, et al., An Anti-CD3 Single-chain Immunotoxin with a Truncated Diphtheria Toxin Avoids Inhibition by Pre-existing Antibodies in Human Blood, J.Biol.Chem., 1995, vol. 270, No. 47, p. 28037-28041.
Thompson, et al., Improved binding of a bivalent single-chain immunotoxin results in increased efficacy for in vivo T-cell depletion, Protein Engineering, 2001, vol. 14, No. 12, pp. 1035-1041.
Thorne, et al., CD36 is a receptor for oxidized high density lipoprotein: implications for the development of atherosclerosis., FEBS Lett. Mar. 20, 2007;581(6):1227-32. Epub Feb. 28, 2007.
Thorpe et al., New coupling agents for the synthesis of immunotoxins containing a hindered disulfide bond with improved stability in Vivo, 1987, Cancer Res. 47:5924-5931.
Thotakura et al., Enzymatic deglycosylating of glycoproteins, 1987, Meth. Enzymol. 138:350.
Thurman et al., Detection of complement activation using monoclonal antibodies against C3d., J Clin Invest. May 2013;123(5):2218-30. doi: 10.1172/JCI65861. Epub Apr. 24, 2013.
Tomlinson et al., Methods for generating multivalent and bispecific antibody fragments, 2000, Methods Enzymol. 326:461-479.
Traunecker, et al., Bispecific single chain molecules (Janusins) target cytotoxic lymphocytes on HIV infected cells, The EMBO Journal, 1991, vol. 1, No. 12, pp. 3655-3659.
Tsurushita et al., Humanization of monoclonal antibodies, 2004, Molecular Biology of B Cells 533-545.
Umaña et al., Engineered glycoforms of an antineuro-blastoma IgG1 with optimized antibody-dependent cellular cytotoxic activity, 1999, Nat Biotechnol 17:176-180.
Valliere-Douglass, et al., O-Fucosylation of an antibody light chain: Characterization of a modification occurring on an IgG1 molecule, Glycobiology, 2009, vol. 19, No. 2, pp. 144-152, doi:10.1093/glycob/cwn116.
Van Boxel, et al., Some lessons from the systematic production and structural analysis of soluble αβ T-cell receptors, Journal of Immunological Methods, 2009, vol. 350, pp. 14-21.
Van Wauwe, et al., OKT3: A Monoclonal Anti-Human T Lymphoctye Antibody with Potent Mitogenic Properties, The Journal of Immunology, 1980, vol. 124, No. 6, pp. 2708-2713.
Verdier, et al., Determination of lymphocyte subsets and cytokine levels in Cynomolgus monkeys, Toxicology, 1995, vol. 105, pp. 81-90.
Verhoeyen et al., Reshaping human antibodies: grafting an antilysozyme activity, 1988, Science, 239:1534-1536.
Veri, et al., Therapeutic Control of B Cell Activation via Recruitment of Fcγ Receptor IIb (CD32B) Inhibitory Function With a Novel Bispecific Antibody Scaffold, Arthritis & Rheumatism, 2010, vol. 62, No. 7, pp. 1933-1943.
Vettermann, et al., Powered by pairing: The surrogate light chain amplifies immunoglobulin heavy chain signaling and pre-selects the antibody repertoire, Seminars in Immunology 18, 2006, pp. 44-55.
Von Kreudenstein, et al., Improving biophysical properties of a bispecific antibody scaffold to aid developability: Quality by molecular design, mAbs, 2013, vol. 5, Issue 5, pp. 1-9, http://dx.doi.org/10.4161/mabs.25632 & Supplemental Material.
Wang et al., Conserved amino acid networks involved in antibody variable domain interactions, Proteins, 2009, vol. 76, pp. 99-114.
Wang et al., Expression and characterization of recombinant soluble monkey CD3 molecules: mapping the FN18 polymorphic epitope, Molecular Immunology, 2004, vol. 40, pp. 1179-1188.

(56) References Cited

OTHER PUBLICATIONS

Wang, et al., A block in both early T lymphocyte and natural killer cell development in transgenic mice with high-copy numbers of the human CD3E gene, Proc. Natl. Acad. Sci. USA, 1994, vol. 91, pp. 9402-9406.

Ward, et al., Protein Engineering of Homodimeric Tyrosyl-tRNA Synthetase to Produce Active Heterodimers, The Journal of Biological Chemistry, 1986, vol. 261, No. 21, pp. 9576-9578.

Weatherill, et al., Towards a universal disulphide stabilised single chain Fv format: importance of interchain disulphide bond location and vL-vH orientation, Protein Engineering, Design & Selection, 2012, vol. 25, No. 7, pp. 321-329.

Weiner, et al., The Role of T Cell Activation Bispecific Antibody Therapy in Anti-CD3 X Antitumor, Journal of Immunology, 1994, vol. 152, pp. 2385-2392.

Wesolowski, et al., Single domain antibodies: promising experimental and therapeutic tools in infection and immunity, Med Microbiol Immunol, 2009, vol. 198, pp. 157-174.

Whitlow, et al., An improved linker for single-chain Fv with reduced aggregation and enhanced proteolytic stability, Protein Engineering, 1993, vol. 6 , No. 8, pp. 989-995.

Wong, et al., The Mechanism of Anti-CD3 Monoclonal Antibodies, Transplantation, 1990, vol. 50, No. 4, pp. 683-689.

Woods, et al., LC-MS characterization and purity assessment of a prototype bispecific antibody, mAbs, 2013, vol. 5, Issue 5, pp. 711-722, http://dx.doi.org/10.4161/mabs.25488.

Woyke et al., In vitro activities and postantifungal effects of the potent dolastatin 10 derivative auristatin PHE, 2001, Antimicrob. Agents and Chemother. 45(12):3580-3584.

Wu et al, Molecular construction and optimization of anti-human IL-11 α/β dual variable domain immunoglobulin (DVD-Ig™) molecules, [mAbs 1:4, 339-347; Jul./Aug. 2009]; Landes Bioscience, Apr. 10, 2009.

Wu et al, Simultaneous targeting of multiple disease mediators by a dual-variable-domain immunoglobulin, (DVD-Ig™) molecules, Jul.-Aug. 2009; 339-347, Oct. 14, 2007.

Wu et al., Humanization of a murine monoclonal antibody by simultaneous optimization of framework and CDR residues, 1999, J. Mol. Biol. 294:151-162.

Wu, et al., Multimerization of a chimeric anti-CD20 single-chain Fv-Fc fusion protein is mediated through variable domain exchange, Protein Engineering, 2001, vol. 14, No. 12, pp. 1025-1033.

Wucherpfennig, et al., Structural Biology of the T-cell Receptor: Insights into Receptor Assembly, Ligand Recognition, and Initiation of Signaling, Cold Spring Harb Perspect Biol 2010;2:a005140.

Xie, et al., A new format of bispecific antibody: highly efficient heterodimerization, expression and tumor cell lysis, Journal of Immunological Methods, 2005, vol. 296 , pp. 95-101, doi: 10.1016/j.jim.2004.11.005.

Xu, et al., Combinatorial surrobody libraries, PNAS, 2008, vol. 105, No. 31, pp. 10756-10761.

Xu, et al., Rapid optimization and prototyping for therapeutic antibody-like molecules, mAbs, 2013, vol. 5, Issue 2, pp. 237-254.

Xu, et al., Surrobodies with Functional Tails, J. Mol. Biol., 2010, vol. 397, pp. 352-360.

Yang et al., Differential in vitro activation of CD8-CD4+ and CD4-CD8+ T lymphocytes by combinations of anti-CD2 and anti-CD3 antibodies, Apr. 1, 1988.

Yelton et al., Affinity maturation of the BR96 anti-carcinoma antibody by codon-based mutagenesis, 1995, J. Immunol. 155:1994-2004.

Yeung, et al., Engineering human IgG1 affinity to human neonatal Fc receptor: impact of affinity improvement on pharmacokinetics in primates, J Immunol. Jun. 15, 2009;182(12):7663-71. doi: 10.4049/jimmunol.0804182.

Yoshino et al., Upgrading of flow cytometric analysis for absolute counts, cytokines and other antigenic molecules of cynomolgus monkeys (Macaca fascicularis) by using anti-human cross-reactive antibodies, Exp. Anim., 2000, vol. 49(2), pp. 97-100.

Yu et al., The biosynthetic gene cluster of the maytansinoids antitumor agent ansamitocin from actinosynnema pretiosum, 2002, PNAS 99:7968-7973.

Zalevsky et al. "Enhanced antibody half-life improves in vivo activity." Nature Biotechnology, vol. 28, No. 2, Feb. 1, 2010, pp. 157-159.

Zamyatnin AA., Amino acid, peptide, and protein vol. in solution., Annu.Rev Biophys Bioenq. 1984:13:145-65.

Zeidler, et al., The Fc-region of a new class of intact bispecific antibody mediates activation of accessory cells and NK cells and induces direct phagocytosis of tumour cells, Br J Cancer, 2000, vol. 83(2), pp. 261-266.

Zhu, et al., Identification of Heavy Chain Residues in a Humanized Anti-CD3 Antibody Important for Efficient Antigen Binding and T Cell Activation, The Journal of Immunology, 1995, vol. 155, pp. 1903-1910.

Zhu, et al., Remodeling domain interfaces to enhance heterodimer formation, Protein Science, 1997, vol. 6, pp. 781-788.

Zeibig et al., Effect of the oxLDL Binding Protein Fc-CD68 on Plaque Extension and Vulnerability in Atherosclerosis., Circulation Research 108: 695-703, 2011.

Zuo, et al., An efficient route to the production of an IgG-like bispecific antibody, Protein Engineering, 2000, vol. 13, No. 5, pp. 361-367.

Sun et al., Anti-CD20/CD3 T cell-dependent bispecific antibody for the treatment of B cell malignancies., Science Translational Medicine May 13, 2015: vol. 7, Issue 287, pp. 287ra70 DOI: 10.1126/scitranslmed.aaa480.

Capizzi et al., Curative chemotherapy for acute myeloid leukemia: the development of high-dose ara-C from the laboratory to bedside., Invest New Drugs. 1996;14(3):249-56.

Giles et al., Intravenous corticosteroids to reduce gemtuzumab ozogamicin infusion reactions. Ann Pharmacother. Sep. 2003;37(9):1182-5.

Duong et al., Targeted treatment of acute myeloid leukemia in older adults: role of gemtuzumab ozogamicin., Clin Interv Aging. 2009;4:197-205. Epub May 14, 2009.

Sun et al. , Preclinical Characterization of Combinability and Potential Synergy of Anti-CD20/CD3 T-Cell Dependent Bispecific Antibody with Chemotherapy and PD-1/PD-L1 Blockade., Blood 2016 128:4168.

Gantke et al., Trispecific antibodies for CD16A-directed NK cell engagement and dual-targeting of tumor cells., Protein Eng Des Sel. Sep. 1, 2017;30(9):673-684. doi: 10.1093/protein/gzx043.

Krupka et al.,Blockade of the PD-1/PD-L1 axis augments lysis of AML cells by the CD33/CD3 BiTE antibody construct AMG 330: reversing a T-cell-induced immune escape mechanism., Leukemia. Feb. 2016;30(2):484-91. doi: 10.1038/leu.2015.214. Epub Aug. 4, 2015.

Osada et al., CEA/CD3-bispecific T cell-engaging (BiTE) antibody-mediated T lymphocyte cytotoxicity maximized by inhibition of both PD1 and PD-L1., Cancer Immunol Immunother. Jun. 2015;64(6):677-88. doi: 10.1007/s00262-015-1671-y. Epub Mar. 6, 2015.

Masarova et al., Immune Checkpoint Approaches in AML and MDS: A Next Frontier?, The Journal of Targeted Therapies in Cancer, Mar. 6, 2017 (Mar. 6, 2017), XP002784099.

Scott et al., Antibody therapy of cancer., Nat Rev Cancer. Mar. 22, 2012;12(4):278-87. doi: 10.1038/nrc3236.

Clynes et al., Redirected T Cell Cytotoxicity in Cancer Therapy., Annu Rev Med. Jan. 27, 2019;70:437-450. doi: 10.1146/annurev-med-062617-035821. Epub Oct. 31, 2018.

Merchant et al., Monovalent antibody design and mechanism of action of onartuzumab, a MET antagonist with anti-tumor activity as a therapeutic agent., Proc Natl Acad Sci U S A. Aug. 6, 2013;110(32):E2987-96. doi: 10.1073/pnas.1302725110. Epub Jul. 23, 2013.

Fos et al., ICOS ligation recruits the p50alpha PI3K regulatory subunit to the immunological synapse., J Immunol. Aug. 1, 2008 ;181(3):1969-77.

(56) References Cited

OTHER PUBLICATIONS

Sanmamed et al., Agonists of Co-stimulation in Cancer Immunotherapy Directed Against CD137, OX40, GITR, CD27, CD28, and ICOS., Semin Oncol. Aug. 2015;42(4):640-55. doi: 10.1053/j.seminoncol. 2015.05.014. Epub Jun. 11, 2015.
Vieira et al., ICOS-mediated signaling regulates cytokine production by human T cells and provides a unique signal to selectively control the clonal expansion ofTh2 helper cells., Eur J Immunol. May 2004;34(5):1282-90.
Madrenas et al., Conversion of CTLA-4 from inhibitor to activator of T cells with a bispecific tandem single-chain Fv ligand., J Immunol. May 15, 2004;172(10):5948-56.
Yokosuka et al., Spatiotemporal basis of CTLA-4 costimulatory molecule-mediated negative regulation of T cell activation., Immunity. Sep. 24, 2010;33(3):326-39. doi: 10.1016/j.immuni.2010.09. 006.
Carpenter et al., Activation of human B cells by the agonist CD40 antibody CP-870,893 and augmentation with simultaneous toll-like receptor 9 stimulation., J Transl Med. Nov. 14, 2009;7:93. doi: 10.1186/1479-5876-7-93.
Fan et al., Engagement of the ICOS pathway markedly enhances efficacy of CTLA-4 blockade in cancer immunotherapy., J Exp Med. Apr. 7, 2014;211 (4):715-25. doi: 10.1084/jem.20130590. Epub Mar. 31, 2014.
Gilboa et al., Use of oligonucleotide aptamer ligands to modulate the function of immune receptors., Clin Cancer Res. Mar. 1, 2013;19(5):1054-62. doi: 10.1158/1078-0432.CCR-12-2067.
Uy et al., Preliminary Results of a Phase 1 Study of Flotetuzumab, a CD123 × CD3 Bispecific Dart® Protein, in Patients with Relapsed/ Refractory Acute Myeloid Leukemia and Myelodysplastic Syndrome., Blood 2017 130:637.
Vey et al., Interim Results from a Phase 1 First-in-Human study of flotetuzumab, a CD123 × CD3 bispecific DART molecule, in AML/MDS., Annals of Oncology (2017) 28 (suppl_5): v355-v371. 10.1093/annonc/mdx373.
Ravandi et al., Complete Responses in Relapsed/Refractory Acute Myeloid Leukemia (AML) Patients on a Weekly Dosing Schedule of XmAb14045, a CD123 × CD3 T Cell-Engaging Bispecific Antibody: Initial Results of a Phase 1 Study., Blood 2018 132:763; doi: https://doi.org/10.1182/blood-2018-99-119786.
Mortier E et al., "Natural, Proteolytic Release of a Soluble Form of Human IL-15 Receptor α-Chain That Behaves as a Specific, High Affinity IL-15 Antagonist", J. Immunol 2004; 173: 1681-1688.
Wrangle et al., ALT-803, an IL-15 superagonist, in combination with nivolumab in patients with metastatic non-small cell lung cancer: a non-randomised, open-label, phase 1b trial., Lancet Oncol. May 2018;19(5):694-704. doi: 10.1016/S1470-2045(18)30148-7. Epub Apr. 5, 2018.
U.S. Appl. No. 12/875,015, 2011-0054151, U.S. Pat. No. 9,493,578, Granted, filed Sep. 2, 2010, Mar. 3, 2011, Nov. 15, 2016.
U.S. Appl. No. 15/279,266, 2017-0058053, Abandoned, filed Sep. 28, 2016, Mar. 2, 2017.
U.S. Appl. No. 16/539,986, Pending, filed Aug. 13, 2019.
U.S. Appl. No. 13/648,951, 2013-0171095, Published, filed Oct. 10, 2012, Jul. 4, 2013.
U.S. Appl. No. 13/194,904, 2012-0028304, U.S. Pat. No. 8,637,641, Granted, filed Jul. 29, 2011, Feb. 2, 2012, Jan. 28, 2014.
U.S. Appl. No. 14/165,487, 2014-0249297, U.S. Pat. No. 9,605,061, Granted, filed Jan. 27, 2014, Sep. 4, 2014, Mar. 28, 2017.
U.S. Appl. No. 15/444,087, 2017-0174757, Abandoned, filed Feb. 27, 2017, Jun. 22, 2017.
U.S. Appl. No. 13/568,028. Abandoned, filed Aug. 6, 2012.
U.S. Appl. No. 14/853,622, 2016-0068588, Published, filed Sep. 14, 2015, Mar. 10, 2016.
U.S. Appl. No. 13/887,234. Abandoned, filed May 3, 2013.
U.S. Appl. No. 14/156,431, 2014-0212435, Abandoned, filed Jan. 15, 2014, Jul. 31, 2014.
U.S. Appl. No. 14/156,432, 2014-0212436, U.S. Pat. No. 9,738,722, Granted, filed Jan. 25, 2014, Jul. 31, 2014, Aug. 22, 2017.
U.S. Appl. No. 14/808,826, 2016-0060360, Abandoned, filed Jul. 25, 2015, Mar. 3, 2016.
U.S. Appl. No. 15/682,380, 2018-0201686, Abandoned, filed Aug. 21, 2017, Jul. 19, 2018.
U.S. Appl. No. 14/155,248, 2014-0322217, Allowed, filed Jan. 14, 2014, Oct. 30, 2014.
U.S. Appl. No. 14/155,334, 2014-0370013, Published, filed Jan. 14, 2014, Dec. 18, 2014.
U.S. Appl. No. 14/155,344, 2014-0294833, U.S. Pat. No. 9,701,759, Granted, filed Jan. 14, 2014, Oct. 2, 2014, Jul. 11, 2017.
U.S. Appl. No. 14/205,227, 2014-0294835, Abandoned, filed Mar. 11, 2014, Oct. 2, 2014.
U.S. Appl. No. 14/205,248, 2014-0288275, U.S. Pat. No. 9,650,446, Granted, filed Mar. 11, 2014, Sep. 25, 2014, May 16, 2017.
U.S. Appl. No. 15/589,908, 2018-0142040, Published, filed May 8, 2017, May 24, 2018.
U.S. Appl. No. 15/633,629, 2018-0215834, Allowed, filed Jun. 26, 2017, Aug. 2, 2018.
U.S. Appl. No. 14/214,418, 2014-0356381, U.S. Pat. No. 10,106,624, Granted, filed Mar. 14, 2014, Dec. 4, 2014, Oct. 23, 2018.
U.S. Appl. No. 16/137,389, Abandoned, filed Sep. 20, 2018.
U.S. Appl. No. 14/214,475, 2014-0294836, Allowed, filed Mar. 14, 2014, Oct. 2, 2014.
U.S. Appl. No. 14/217,166, 2014-0294759, Allowed, filed Mar. 17, 2014, Oct. 2, 2014.
U.S. Appl. No. 14/200,652, 2014-0302064, Published, filed Mar. 7, 2014, Oct. 9, 2014.
U.S. Appl. No. 14/207,489, 2014-0377270, U.S. Pat. No. 10,131,710, Granted, filed Mar. 12, 2014, Dec. 25, 2014, Nov. 20, 2018.
U.S. Appl. No. 16/162,172, 2019-0270810, Published, filed Oct. 16, 2018, Sep. 5, 2019.
U.S. Appl. No. 14/200,821, 2014-0294823, U.S. Pat. No. 9,605,084, Granted, filed Mar. 7, 2014, Oct. 2, 2014, Mar. 28, 2017.
U.S. Appl. No. 14/216,705, 2014-0363426, Published, filed Mar. 17, 2014, Dec. 11, 2014.
U.S. Appl. No. 15/444,026, 2018-0037668, U.S. Pat. No. 10,287,364, Granted, filed Feb. 27, 2017, Feb. 8, 2018, May 14, 2019.
U.S. Appl. No. 16/364,093, Pending, filed Mar. 25, 2019.
U.S. Appl. No. 14/673,695, 2015-0307629, Transferred, filed Mar. 30, 2015, Oct. 9, 2015.
U.S. Appl. No. 15/786,252, 2018-0094079, Published, filed Oct. 17, 2017. Apr. 5, 2018.
U.S. Appl. No. 14/952,705, 2016-0176969, Abandoned, filed Nov. 25, 2015, Jun. 23, 2016.
U.S. Appl. No. 14/952,714, 2016-0229924, Published, filed Nov. 25, 2015, Aug. 11, 2016.
U.S. Appl. No. 15/141,350, 2016-0355608, U.S. Pat. No. 10,259,887, Granted, filed Apr. 28, 2016, Dec. 8, 2016, Apr. 16, 2019.
U.S. Appl. No. 15/945,679, 2018-0282432, Published, filed Apr. 4, 2018, Oct. 4, 2018.
U.S. Appl. No. 15/945,681, 2018-0223000, Published, filed Apr. 4, 2018, Aug. 9, 2018.
U.S. Appl. No. 16/354,058, 2019-0202938, Published, filed Mar. 14, 2019, Jul. 4, 2019.
U.S. Appl. No. 14/952,786, 2016-0215063, Transferred, filed Nov. 25, 2015, Jul. 28, 2016.
U.S. Appl. No. 15/779,325, Pending, filed May 28, 2018.
U.S. Appl. No. 14/757,809, 2016-0355600, U.S. Pat. No. 10,428,155, Allowed, filed Dec. 22, 2015, Dec. 8, 2016, Oct. 1, 2019.
U.S. Appl. No. 16/530,946. Pending, filed Aug. 2, 2019.
U.S. Appl. No. 15/063,441, 2017-0037131, U.S. Pat. No. 10,227,411, Granted, filed Mar. 7, 2016, Feb. 9, 2017, Mar. 12, 2019.
U.S. Appl. No. 16/297,255, 2019-0194325, Published, dated Mar. 8, 2019, Jun. 27, 2019.
U.S. Appl. No. 15/372,360, 2017-0320947, U.S. Pat. No. 10,227,410, Granted, filed Dec. 7, 2016, Nov. 9, 2017, Mar. 12, 2019.
U.S. Appl. No. 16/489,539, Pending, filed Aug. 28, 2019.
U.S. Appl. No. 15/623,314, 2018-0118836, Published, filed Jun. 14, 2017, May 3, 2018.
U.S. Appl. No. 16/435,373, Pending, filed Jun. 7, 2019.
U.S. Appl. No. 16/435,375. Pending, filed Jun. 7, 2019.
U.S. Appl. No. 15/611,361, 2017-0349660, Published, filed Jun. 1, 2017, Dec. 7, 2017.

(56) References Cited

OTHER PUBLICATIONS

U.S. Appl. No. 15/611,683, 2017-0349657, Published, filed Jun. 1, 2017, Dec. 7, 2017.
U.S. Appl. No. 15/636,590, 2018-0118827, U.S. Pat. No. 10,316,088, Granted, filed Jun. 28, 2017, May 3, 2018, Jun. 11, 2019.
U.S. Appl. No. 16/393,900, 2019-0248898, Published, filed Apr. 24, 2019, Aug. 15, 2019.
U.S. Appl. No. 15/185,958, 2017-0081420, U.S. Pat. No. 9,850,320, Granted, filed Jun. 17, 2016, Mar. 23, 2017, Dec. 26, 2017.
U.S. Appl. No. 15/186,167, 2017-0081424, U.S. Pat. No. 9,856,327, Granted, filed Jun. 17, 2016, Mar. 23, 2017, Jan. 2, 2018.
U.S. Appl. No. 15/691,665, 2018-0127501, Published, filed Aug. 30, 2017, May 10, 2018.
U.S. Appl. No. 15/785,401, 2018-0118805, U.S. Pat. No. 10,501,543, Allowed, filed Oct. 16, 2017, May 3, 2018, Dec. 10, 2019.
U.S. Appl. No. 15/785,393, 2018-0118828, Allowed, filed Oct. 16, 2017, May 3, 2018.
U.S. Appl. No. 16/388,174, Pending, filed Apr. 18, 2019.
U.S. Appl. No. 16/388,811, Pending, filed Apr. 18, 2019.
U.S. Appl. No. 16/600,236, Pending, filed Oct. 11, 2019.
U.S. Appl. No. 16/025,963, 2019-0016778, Published, filed Jul. 2, 2018, Jan. 17, 2019.
U.S. Appl. No. 16/184,895, 2019-0263909, Published, filed Nov. 8, 2018, Aug. 29, 2019.
U.S. Appl. No. 16/184,929, 2019-0270816, Published, filed Nov. 8, 2018, Sep. 5, 2019.
U.S. Appl. No. 16/206,849, 2019-0241638, Published, filed Nov. 30, 2018, Aug. 8, 2019.
U.S. Appl. No. 16/375,777, Pending, filed Apr. 4, 2019.
U.S. Appl. No. 16/388,646, 2019-0352362, Published, filed Apr. 18, 2019, Nov. 21, 2019.
U.S. Appl. No. 16/388,729, Pending, filed Apr. 18, 2019.
U.S. Appl. No. 16/592,656, Pending, filed Oct. 3, 2019.
Boswell et al., Effects of Charge on Antibody Tissue Distribution and Pharmacokinetics, 2010, Bioconjugate Chem, 21 (21):2153-2163.
Brandl, et al., Bispecific antibody fragments with CD20 3 CD28 specificity allow effective autologous and allogeneic T-cell activation against malignant cells in peripheral blood and bone marrow cultures from patients with B-cell lineage leukemia and lymphoma, Experimental Hematology, 1999, vol. 27, pp. 1264-1270.
Brinkmann, et al., presentation slideshow—"Roche Penzberg & Roche Glycart, Schlieren: Centers of Excellence for Recombinant Proteins".
Brinkmann, et al., A recombinant immunotoxin containing a disulfide-stabilized Fv fragment, Proc. Natl. Acad. Sci. USA, 1993, vol. 90, pp. 7538-7542.
Cao, et al., Oligomerization is required for the activity of recombinant soluble LOX-1., FEBS J. Sep. 2009;276(17):4909-20. doi: 10.1111/j.1742-4658.2009.07190.x. Epub Jul. 31, 2009.
Carpenter, et al., Non-Fc Receptor-Binding Humanized Anti-CD3 Antibodies Induce Apoptosis of Activated Human T Cells, J. Immunol., 2000, vol. 165, No. 11, pp. 6205-6213.
Carter et al., Antibody-drug conjugates for cancer therapy, 2008, Cancer J. 14(3):154-169.
Carter et al., Humanization of an anti-p185HER2 antibody for human cancer therapy, 1992, Proc Natl Acad Sci USA 89:4285-9.
Castoldi, et al., Molecular characterization of novel trispecific ErbB-cMet-IGF1R antibodies and their antigen-binding properties, Protein Engineering, Design & Selection, 2012, vol. 25, No. 10, pp. 551-559.
Fudenberg, et al., Serologic Demonstration of Dual Specificity of Rabbit Bivalent Hybrid Antibody, The Journal of Experimental Medicine, 1964, vol. 119(1), pp. 151-166.
Ganesan, et al., FcγRIIb on Liver Sinusoidal Endothelium Clears Small Immune Complexes, The Journal of Immunology, Nov. 15, 2012, vol. 189 No. 10, pp. 4981-4988.
GenBank AAA38124.1, immunoglobulin heavy-chain VJ region [Mus musculus] Protein/NCBI, 1993.

GenBank AAA39180.1, immunoglobulin light-chain VJ region [Mus musculus] Protein/NCBI, 1993.
Ghendler et al., One of the CD38 Subunits within a T Cell Receptor Complex Lies in Close Proximity to the Cβ FG Loop, J. Exp. Med., 1998, vol. 187, No. 9. pp. 1529-1536.
Ghetie et al., Multiple roles for the major histocompatibility complex Class I-related receptor FcRn, 2000, Annu Rev Immunol 18:739-766.
Gilliland, et al., Universal bispecific antibody for targeting tumor cells for destruction by cytotoxic T cells, Proc. Natl. Acad. Sci. USA, 1988, vol. 85, pp. 7719-7723.
Gorman et al., Reshaping a therapeutic CD4 antibody, Proc. Natl. Acad. Sci. USA 88:4181-4185, 1991.
Grodzki & Bernstein, "Antibody Purification: Ion-Exchange Chromatography.", Methods Mol Biol 2010 ;588:27-32.
Gunasekaran et al., Enhancing Antibody Fc Heterodimer Formation through Electrostatic Steering Effects, Journal of Biological Cheminstry, vol. 285, No. 25, pp. 19637-10946, Apr. 16, 2010 & Supplementary Tables.
Bacac et al., A Novel Carcinoembryonic Antigen T-Cell Bispecific Antibody (CEA TCB) for the Treatment of Solid Tumors., Clin Cancer Res. Jul. 1, 2016;22(13):3286-97.
Chappel et al., "Identification of a Secondary Fcγ RI Binding Site within a Genetically Engineered Human IgG Actibody," J. Biol. Chem., 268(33):25124-25131 (Nov. 1993).
Chappel et al., "Identification of the Fcγ receptor class I binding site in human IgG through the use of recombinant IgG1/IgG2 hybrid and point-mutated antibodies," PNAS, USA, 88:9036-9040 (Oct. 1991).
Miranda-Carus et al., IL-15 and the initiation of cell contact-dependent synovial fibroblast-T lymphocyte cross-talk in rheumatoid arthritis: effect of methotrexate., 2004 J. Immunol. 13:1463-1476.
Koka et al., Cutting edge: murine dendritic cells require IL-15R alpha to prime NK cells., 2004 J. Immunol. 173:3594-3598.
Matsumoto et al., On-column refolding and characterization of soluble human interleukin-15 receptor alpha-chain produced in *Escherichia coli*., Protein Purification and Expression, 2003 64-71.
Schluns et al., Distinct cell types control lymphoid subset development by means of IL-15 and IL-15 receptor alpha expression., PNAS 101(5):5616-5621, 2004.
Wei et al., The Sushi domain of soluble IL-15 receptor alpha is essential for binding IL-15 and inhibiting inflammatory and allogenic responses in vitro and in vivo., J. Immunol. 167:277-282, 2011.
Han et al., IL-15:IL-15 receptor alpha superagonist complex: high-level co-expression in recombinant mammalian cells, purification and characterization., Cytokine. Dec. 2011;56(3):804-10.
Igawa et al., Reduced elimination of IgG antibodies by engineering the variable region, 2010, PEDS. 23(5): 385-392.
Igawa, $V_H/V_L$ interface engineering to promote selective expression and inhibit conformational isomerization of thrombopoietin receptor agonist single-chain diabody, Protein Engineering, Design & Selection, 2010, vol. 23, No. 8, pp. 667-677.
Ishigaki et al., Impact of Plasma Oxidized Low-Density Lipoprotein Removal on Atherosclerosis., Circulation 118: 75-83, 2008.
Jackson et al., In vitro antibody maturation, 1995, J. Immunol. 154(7):3310-9.
Jäger, et al., The Trifunctional Antibody Ertumaxomab Destroys Tumor Cells That Express Low Levels of Human Epidermal Growth Factor Receptor 2, Cancer Res, 2009, vol. 69(10), pp. 4270-4276.
Jefferis et al., Interaction sites on human IgG-Fc for FcγR: current models, 2002, Immunol Lett 82:57-65.
Jespers, et al., Crystal Structure of HEL4, a Soluble, Refoldable Human $V_H$ Single Domain with a Germ-line Scaffold, J. Mol. Biol., 2004, vol. 337, pp. 893-903.
Jimenez, et al., A recombinant, fully human, bispecific antibody neutralizes the biological activities mediated by both vascular endothelial growth factor receptors 2 and 3, Mol Cancer Ther, 2005, vol. 4(3), pp. 427-434.
Jin et al. The Design and Engineering of IgG-Like Bispecific Antibodies., Chapter 9, Bispecific Antibodies, pp. 151-169, 2011.
Jin, et al., MetMAb, the One-Armed 5D5 Anti-c-Met Antibody, Inhibits Orthotopic Pancreatic Tumor Growth and Improves Survival, Cancer Res 2008, vol. 68, pp. 4360-4368.

(56) References Cited

OTHER PUBLICATIONS

Stone et al., Design and characterization of a protein superagonist of IL-15 fused with IL-15Rα and a high-affinity T cell receptor., Biotechnol Prog. 2012; Nov.-Dec.;28(6):1588-97.
Kermer et al., An antibody fusion protein for cancer immunotherapy mimicking IL-15 trans-presentation at the tumor site., Mol Cancer Ther. Jun. 2012;11(6):1279-88.
Kermer et al., Combining Antibody-Directed Presentation of IL-15 and 4-1BBL in a Trifunctional Fusion Protein for Cancer Immunotherapy, Mol Cancer Ther. Jan. 2014;13(1):112-21.
C. Bergamaschi et al., "Intracellular Interaction of Interleukin-15 with Its Receptor during Production Leads to Mutual Stabilization and Increased Bioactivity", Journal of Biological Chemistry, vol. 283, No. 7, pp. 4189-4199, 2008.
Genbank accession No. NM_172174, 2011.
Genbank accession No. NP_002180, 2021.
S. Dubois et al., "IL-15Rα Recycles and Presents IL-15 In Trans to Neighbouring Cells", Immunity, vol. 17, 537-547, 2002.
Y Tagaya et al., "Generation of secretable and non-secretable interleukin-15 isoforms through alternate usage of signal peptides", Proc. Natl. Acad. Sci. USA, vol. 44, 14444-14449, 1997.
Genbank accession No. AF031167.1, 1998.
D Anderson et al., "Functional Characterization of the Human IL-15 Receptor α Chain and Close Linkage of IL15RA and IL2RA genes", J. Biol. Chem., vol. 270, No. 50, 29862-29869, 1995.
Matthew J Bernett et al.: Abstract 5565: Potency-reduced IL15/IL15R[alpha] heterodimeric Fe-fusions display enhanced in vivo activity through increased exposure 11, Cancer Research, vol. 78, No. 13(Suppl) Apr. 18, 2018 (Apr. 18, 2018), pp. 1-2, XP055658295. abstract.
Ha et al., Immunoglobulin Fc Heterodimer Platform Technology: From Design to Applications in Therapeutic Antibodies and Proteins., Front Immunol. 2016; 7: 394. Published online Oct. 6, 2016. doi: 10.3389/fimmu.2016.00394.
Rhode et al., Comparison of the Superagonist Complex, ALT-803, to IL15 as Cancer Immunotherapeutics in Animal Models., Cancer Immunol Res. Jan. 2016;4(1):49-60. doi: 10.1158/2326-6066.CIR-15-0093-T. Epub Oct. 28, 2015.
Steinbacher et al., An Fc-optimized NKG2D-immunoglobulin G Fusion Protein for Induction of Natural Killer Cell Reactivity Against Leukemia, Int J Cancer. Mar. 1, 2015;136(5):1073-84. doi: 10.1002/ijc.29083. Epub Jul. 28, 2014.
Prajapati et al., Functions of NKG2D in CD8 + T Cells: An Opportunity for Immunotherapy., Cell Mol Immunol. May 2018;15(5):470-479. doi: 10.1038/cmi.2017.161. Epub Feb. 5, 2018.
Wells, Additivity of mutational effects in proteins., Biochemistry 1990, 29, 37, 8509-8517.
Bork, Powers and Pitfalls in Sequence Analysis: The 70% Hurdle., Genome Res. 2000. 10:398-400.
Skolnick et al., From Genes to Protein Structure and Function: Novel Applications of Computational Approaches in the Genomic Era., Trends Biotechnol. Jan. 2000;18(1):34-9.
Doerks et al., Protein annotation: detective work for function prediction., Trends in Genetics, 1998 vol. 14, ISSUE 6, p. 248-250, Jun. 1, 1998.
Tokuriki et al., Stability effects of mutations and protein evolvability., Current Opinion in Structural Biology 2009, 19: 596-604.
Alter et al., Targeted IL-15-based Protein Fusion Complexes as Cancer Immunotherapy Approaches., J Immunological Sci. (2018); 2(1): 15-18.
Bailey et al., New interleukin-15 superagonist (IL-15SA) significantly enhances graft-versus-tumor activity., Oncotarget. Jul. 4, 2017; 8(27): 44366-44378.
Charych et al., NKTR-214, an Engineered Cytokine with Biased IL2 Receptor Binding, Increased Tumor Exposure, and Marked Efficacy in Mouse Tumor Models., Clin Cancer Res; 22(3) Feb. 1, 2016.
Chen et al., A targeted IL-15 fusion protein with potent antitumor activity., (2015) Cancer Biology & Therapy, 16:9, 1415-1421, DOI: 10.1080/15384047.2015.1071739.
Ghasemi et al., Selective targeting of IL-2 to NKG2D bearing cells for improved immunotherapy., Nature Communications vol. 7, Article No. 12878 (2016).
Jochems et al., The multi-functionality of N-809, a novel fusion protein encompassing anti-PD-L1 and the IL-15 superagonist fusion complex., OncoImmunology, 2019, vol. 8, No. 2, e1532764 (15 pages).
Klein et al., Cergutuzumab amunaleukin (CEA-IL2v), a CEAtargeted IL-2 variant-based immunocytokine for combination cancer immunotherapy: Overcoming limitations of aldesleukin and conventional IL-2-based immunocytokines.,(2017) OncoImmunology, 6:3, e1277306, DOI: 10.1080/2162402X.2016.1277306.
Olsen et al., Crystal Structure of the Interleukin-15 * Interleukin-15 Receptor α Complex., The Journal of Biological Chemistry vol. 282, No. 51, pp. 37191-37204, Dec. 21, 2007.
Vallera et al., IL15 Trispecific Killer Engagers (TriKE) Make Natural Killer Cells Specific to CD33β Targets While Also Inducing Persistence, In Vivo Expansion, and Enhanced Function., Clin Cancer Res; 22(14) Jul. 15, 2016.
Xu et al., Efficacy and Meehanism-of-Action of a Novel Superagonist Interleukin-15: Interleukin-15 Receptora Su/Fc Fusion Complex in Syngeneic Murine Models of Multiple Myeloma., Cancer Res. May 15, 2013;73(10):3075-86.
Zhu et al., Novel Human Interleukin-15 Agonists., The Journal of Immunology; 2009; vol. 183, No. 6; pp. 1-28.
Bernard et al., Identification of an lnterleukin-15α Receptor-binding Site on Human Interleukin-15*., The Journal of Biological Chemistry; 2004; vol. 279, No. 23, pp. 24313-24322.
Robinson et al., The potential and promise of IL-15 in immuno-oncogenic therapies, Immunology Letters, vol. 190, 2017, pp. 159-168.
Schmid et al., Design and characterisation of a novel interleukin-15 receptor alpha fusion protein and analysis of interleukin-15 complexation., PLoS One. Jul. 26, 2019;14(7):e0219313.
Genbank accession No. U31628, Dec. 19, 1995.
Muller, Dafne, Targeted cancer immunotherapy, Mimicking physiological trans-presentation of IL-15., Oncoimmunology. Oct. 1, 2012; 1(7): 1213-1214.
Garcin et al. High efficiency cell-specific targeting of cytokine activity. Nat Commun 5, 3016 (2014).
Kaspar et al., The anti body-mediated targeted delivery of interleukin-15 and GM-CSF to the tumor neovasculature inhibits tumor growth and metastasis., Cancer Res. May 15, 2007;67(10):4940-8.
Conlon et al., Redistribution, hyperproliferation, activation of natural killer cells and CD8 T cells, and cytokine production during first-in-human clinical trial of recombinant human interleukin-15 in patients with cancer., J Clin Oncol. Jan. 1, 2015;33(1):74-82.
List et al., Immunocytokines: a review of molecules in clinical development for cancer therapy., Clin Pharmacol. 2013; 5(Suppl 1): 29-45.
Gillies et al., Antibody-targeted interleukin 2 stimulates T-cell killing of autologous tumor cells., PNAS Feb. 15, 1992 89 (4) 1428-1432.
Albertini et al. Phase II trial of hu14.18-IL2 for patients with metastatic melanoma., Cancer Immunol Immunother. Dec. 2012;61(12):2261-71.
Ribas et al., Phase I/II open-label study of the biologic effects of the interleukin-2 immunocytokine EMD 273063 (hu14.18-IL2) in patients with metastatic malignant melanoma., J Transl Med. Jul. 29, 2009;7:68.
Hofmann et al., Generation, selection and preclinical characterization of an Fc-optimized FLT3 antibody for the treatment of myeloid leukemia., Leukemia. Jun. 2012;26(6):1228-37.
Kellner et al., Heterodimeric bispecific antibody-derivatives against CD19 and CD16 induce effective antibody-dependent cellular cytotoxicity against B-lymphoid tumor cells., Cancer Lett. Apr. 28, 2011;303(2):128-39.
Skera, Arne, 'Anticalins': a new class of engineered ligand-binding proteins with antibody-like properties., J Biotechnol. Jun. 2001;74(4):257-75.
Skera, Arne, Engineered protein scaffolds for molecular recognition., J Mol Recognit. Jul.-Aug. 2000;13(4):167-87.

(56) References Cited

OTHER PUBLICATIONS

Horton et al. Potent in vitro and in vivo activity of an Fc-engineered anti-CD19 monoclonal antibody against lymphoma and leukemia., Cancer Res, 2008, vol. 68, 8049-8057.
Ortiz-Sánchez et al., Antibody-cytokine fusion proteins: applications in cancer therapy., Expert Opin Biol Ther. May 2008 ; 8(5): 609-632.
Zhu et al., Novel Human Interleukin-15 Agonists., J Immunol Sep. 15, 2009, 183 (6) 3598-3607.
Xia et al., In vivo effect of recombined IL-15/Fc fusion protein on EAU. Sichuan Da Xue Xue Bao Yi Xue Ban. Nov. 2008;39(6) 944-949.
Wu et al., IL-15Rα-IgG1-Fc Enhances IL-2 and IL-15 Anti-tumor Action through NK and CD8+ T Cells Proliferation and Activation., Journal of Molecular Cell Biology, vol. 2, Issue 4, Aug. 2010, pp. 217-222.
Ridgway et al., 'Knobs-into-holes' engineering of antibody CH3 domains for heavy chain heterodimerization., Protein Engineering, Design and Selection, vol. 9, Issue 7, Jul. 1996, pp. 617-621.
Carter P. Bispecific human IgG by design. J Immunol Methods. Feb. 1, 2001 ;248(1-2):7-15. doi: 10.1016/s0022-1759(00)00339-2. PMID: 11223065.
Atwell et al., Stable heterodimers from remodeling the domain interface of a homodimer using a phage display library 1 .,Journal of Molecular Biology, vol. 270, Issue 1, 1997,pp. 26-35, ISSN 0022-2836, https://doi.org/10.1006/jmbi.1997.1116.
Merchant, et al., An efficient route to human bispecific IgG, Nature Biotechnology, 1998, vol. 16, pp. 677-681.
Klein, et al., Progress in overcoming the chain association issue in bispecific heterodimeric IgG antibodies, mAbs, Nov.-Dec. 2012, vol. 4, issue 6, pp. 653-663, doi: 10.4161/mabs.21379, Epub Aug. 27, 2012.
Deshpande et al., (2013), Kinetic analysis of cytokine-mediated receptor assembly using engineered FC heterodimers. Protein Science, 22: 1100-1108. https://doi.org/10.1002/pro.2285.
Dumont et al. Monomeric Fc Fusions. BioDrugs 20, 151-160 (2006). https://doi.org/10.2165/00063030-200620030-00002.
Belladonna et al., (2013) Bioengineering heterodimeric cytokines: turning promiscuous proteins into therapeutic agents, Biotechnology and Genetic Engineering Reviews, 29:2, 149-174, DOI: 10.1080/02648725.2013.801228.
Hinrichs, Christian S., Can interleukin-15 keep its therapeutic promise? Science Translational Medicine Mar. 7, 2018:vol. 10, Issue 431, eaar7532, DOI: 10.1126/scitranslmed.aar7532.
Rubinstein et al., Converting IL-15 to a superagonist by binding to soluble IL-15R{alpha}. Proc Natl Acad Sci U S A. Jun. 13, 2006;103(24):9166-71. doi: 10.1073/pnas.0600240103. Epub Jun. 6, 2006. PMID: 16757567; PMCID: PMC1482584.
Stoklasek et al., Combined IL-15/IL-15Ralpha immunotherapy maximizes IL-15 activity in vivo. J Immunol. Nov. 1, 2006;177(9):6072-80. doi: 10.4049/jimmunol.177.9.6072. PMID: 17056533; PMCID: PMC2847275.
Landolfi NF. A chimeric IL-2/Ig molecule possesses the functional activity of both proteins. J Immunol. Feb. 1, 1991;146(3):915-9. PMID: 1988502.
Zheng et al., Administration of noncytolytic IL-10/Fc in murine models of lipopolysaccharide-induced septic shock and allogeneic islet transplantation., J Immunol May 15, 1995, 154 (10) 5590-5600.
Low, et al., Oral and pulmonary delivery of FSH-Fc fusion proteins via neonatal Fc receptor-mediated transcytosis, Human Reproduction, vol. 20, Issue 7, Jul. 2005, pp. 1805-1813.
Kim et al., Targeting the IL-15 Receptor with an Antagonist IL-15 Mutant/Fcγ2a Protein Blocks Delayed-Type Hypersensitivity., J Immunol Jun. 15, 1998, 160 (12) 5742-5748.
Larrick et al., 2013, Inflammation, Advancing Age and Nutrition. D26 Chapter 28. Trophokines: Novel Therapy for Senescence-Related Fibrosis htto://dx rlo1.ora/10 1016/B978-0-12-397803-5.00028-9.

Mortier et al., Soluble interleukin-15 receptor alpha (IL-15R alpha)-sushi as a selective and potent agonist of IL-15 action through IL-15R beta/gamma. Hyperagonist IL-15 x IL-15R alpha fusion proteins. J Biol Chem. Jan. 20, 2006;281(3):1612-9. doi: 10.1074/jbc.M508624200. Epub Nov. 11, 2005. PMID: 16284400.
Wu J. IL-15 Agonists: The Cancer Cure Cytokine. J Mol Genet Med. Oct. 28, 2013;7:85. doi: 10.4172/1747-0862.1000085. PMID: 24587813; PMCID: PMC3938108.
C. Spiess et al., J. Biol. 288(37):26583-93 (2013), Development of a Human IgG4 Bispecific Antibody for Dual Targeting of lnterleukin-4 (IL-4) and Interleukin-13 (IL-13) Cytokines.
Hopp et al. 1988. "A Short Polypeptide Marker Sequence Useful for Recombinant Protein Identification and Purification" Nat. Biotechnol. 6, 1204-1210.
Budagian et al., IL-15/IL-15 receptor biology: a guided tour through an expanding universe., Cytokine Growth Factor Rev. Aug. 2006;17(4):259-8.
Bodnar et al., A biophysical approach to IL-2 and IL-15 receptor function: Localization, conformation and interactions., Immunology Letters 116 (2008) 117-125.
Numerof et al., Cytokines as Potential Therapeutic Targets for Inflammatory Skin Diseases., Springer-Verlag, Berlin Heidelberg 2006.
Dumont, Francis J. (2005) lnterleukin-2 family cytokines: potential for therapeutic immmunoregulation, Expert Opinion on Therapeutic Patents, 15:5, 521-554.
Savio et al., IL-15: a relevant cytolcine for lymphoid homeostasis and autoimmune diseases., Biotecnologia Ap/icada 2006;23:87-93.
Lichtenegger et al., Targeting LAG-3 and PD-1 to Enhance T Cell Activation by Antigen-Presenting Cells., Front. Immunol. Feb. 27, 2018; 9: 385; pp. 1-12.
Guo et al., Immunobiology of the IL-15/IL-15Rα complex as an antitumor and antiviral agent., Cytokine Growth Factor Rev. Dec. 2017; 38: 10-21.
Ng et al., Heterodimeric IL15 Treatment Enhances Tumor Infiltration, Persistence, and Effector Functions of Adoptively Transferred Tumor-specific T Cells in the Absence of Lymphodepletion., Clin. Cancer Res. Jun. 2017; 23 (11): 2817-30.
Liang et al., Targeting IFNα to tumor by anti-PD-L1 creates feedforward antitumor responses to overcome checkpoint blockade resistance ., Nat. Commun. Nov. 2, 2018; 9 (1): 4586.
Chen et al., Therapeutic efficacy of an anti-PD-L1 antibody based immunocytokine in a metastatic mouse model of colorectal cancer., Biochem. Biophys. Res. Commun. Nov. 11, 2016; 480 (2): 160-5.
Kiefer et al., Immunocytokines and bispecific antibodies: two complementary strategies for the selective activation of immune cells at the tumor site., Immunol. Rev. Mar. 2016; 270 (1): 178-92; author manuscript; pp. 1-27.
Sondel et al., Current and Potential Uses of Immunocytokines as Cancer Immunotherapy., Antibodies. 212; 1: 149-71, 2012.
Kim et al., IL-15 superagonist/IL-15RαSushi-Fc fusion complex (IL-15SA/IL-15RαSu-Fc; ALT-803) markedly enhances specific subpopulations of NK and memory CD8+ T cells, and mediates potent anti-tumor activity against murine breast and colon carcinomas., Oncotarget. Mar. 29, 2016; 7 (13): 16130-45.
Rogers et al., Molecular characterization of immunoglobulin D in mammals: immunoglobulin heavy constant delta genes in dogs, chimpanzees and four old world monkey species., Immunology. May 2006; 118 (1): 88-100.
Rowley J. et al., Inhibition of tumor growth by NK1. 1+ cells and CD8+ T cells activated by IL-15 through receptor β/common γ signaling in trans, The Journal of Immunology, 2008, V. 181, N. 12, p. 8237-8247, p. 8237.
Shen J. et al., Single variable domain-IgG fusion: a novel recombinant approach to Fc domain-containing bispecific antibodies, Journal of Biological Chemistry, 2006, V. 281, N. 16, p. 10706-10714, p. 10713.
Chen X. et al., Fusion protein linkers: property, design and functionality, Advanced drug delivery reviews, 2013, V. 65, N. 10, p. 1357-1369, the whole text, p. 1365.
Maeda Y. et al., Engineering of functional chimeric protein G-VargulaLuciferase, Analytical biochemistry, 1997, V. 249, N. 2, p. 147-152, the whole text, p. 148, p. 151.

(56) References Cited

OTHER PUBLICATIONS

Gasser B. et al., Antibody production with yeasts and filamentous fungi: on the road to large scale? Biotechnology letters, 2007, V. 29, N. 2, p. 201-212, p. 208.
An Z., Therapeutic monoclonal antibodies: from bench to clinic, John Wiley And Sons, 2011, 896 p., p. 350.
Burns W. R. et al., A high molecular weight melanoma-associated antigen-specific chimeric antigen receptor redirects lymphocytes to target human melanomas, Cancer research, 2010, V. 70, N. 8, p. 3027-3033, p. 3028.
Colman P. M., Effects of amino acid sequence changes on antibody-antigen interactions, Research in Immunology, 1994, V. 145, N. 1, p. 33-36, c.33.
Safdari Y. et al., Antibody humanization methods-a review and update, Biotechnology and Genetic Engineering Reviews, 2013, V. 29, N. 2, p. 175-186, p. 178, 180.
Teplyakov A. et al., Antibody modeling assessment II. Structures and models, Proteins: Structure, Function, and Bioinformatics, 2014, V. 82, N. 8, p. 1563-1582, the whole text, p. 1582).
Yu et al. Simultaneous blockade of multiple immune system inhibitory checkpoints enhances antitumor activity mediated by interleukin-15 in a murine metastatic colon carcinoma model. Clin Cancer Res. 2010;16(24):6019-6028.
Vincent et al. Tumor targeting of the IL-15 superagonist RLI by an anti-GD2 antibody strongly enhances its antitumor potency. Int J Cancer. 2013;133(3):757-765.
Vincent et al. CS14-6. Development of two IL15 immunocytokines targeting either GD2- or CD20- tumoral bearing cells. Cytokine. 2011;56 (1):102.
Xu et al. The tumor immunosuppressive microenvironment impairs the therapy of anti-HER2/neu antibody. Protein Cell. 2012;3(6):441-449.
Bessard et al. High antitumor activity of RLI, an interleukin-15 (IL-15)-IL-15 receptor alpha fusion protein, in metastatic melanoma and colorectal cancer. Mol Cancer Ther. 2009;8(9):2736-2745.
Yu et al., "Simultaneous inhibition of two regulatory T-cell subsets enhanced Interleukin-15 efficacy in a prostate tumor model.", Proc Natl Acad Sci USA. 2012;109(16):6187-6192.
Perdreau et al. "Different dynamics of IL-15R activation following IL-15 cis- or trans-presentation." Eur Cytokine Netw. Dec. 2010;21(4):297-307.
Desbois et al. "IL-15 Trans-Signaling with the Superagonist RLI Promotes Effector/Memory CD8+ T Cell Responses and Enhances Antitumor Activity of PD-1 Antagonists.", J Immunol. Jul. 1, 2016 ;197(1):168-78. doi: 10.4049/jimmunol.1600019. Epub May 23, 2016.
Intlekofer et al., "At the Bench: Preclinical rationale for CTLA-4 and PD-1 blockade as cancer immunotherapy", Journal of Leukocyte Biology, vol. 94, Jul. 2013.
Melero et al.: "Evolving synergistic combinations of targeted immunotherapies to combat cancer", Nature Reviews, Cancer, vol. 15, 2015.
Waldmann: "The biology of interleukin-2 and interleukin-15: implications for cancer therapy and vaccine design", 2006, Nat Rev Immunol 6(8): 595-601.
Dubois et al., Preassociation of IL-15 with IL-15Rα-IgG1-Fc Enhances Its Activity on Proliferation of NK and CD8+/CD44high T Cells and Its Antitumor Action., J Immunol Feb. 15, 2008, 180 (4) 2099-2106; DOI: https://doi.org/10.4049/jimmunol.180.4.2099.

* cited by examiner

Figure 3A

Human IL-15 precursor sequence

>sp|P40933  SEQ ID NO:5
MRISKPHLRSISIQCYLCLLLNSHFLTEAGIHVFILGCFSAGLPKTEANWVNVISDLKKIEDLIQSMHIDATLYT
ESDVHPSCKVTAMKCFLLELQVISLESGDASIHDTVENLIILANNSLSSNGNVTESGCKECEELEEKNIKEFLQS
FVHIVQMFINTS

Human IL-15 mature form sequence

>sp|P40933|49-162 SEQ ID NO:6
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Human IL-15Rα sequence

>sp|Q13261 SEQ ID NO:7
MAPRRARGCRTLGLPALLLLLLLRPPATRGITCPPPMSVEHADIWVKSYSLYSRERYICNSGFKRKAGTSSLTEC
VLNKATNVAHWTTPSLKCIRDPALVHQRPAPPSTVTTAGVTPQPESLSPSGKEPAASSPSSNNTAATTAAIVPGS
QLMPSKSPSTGTTEISSHESSHGTPSQTTAKNWELTASASHQPPGVYPQGHSDTTVAISTSTVLLCGLSAVSLLA
CYLKSRQTPPLASVEMEAMEALPVTWGTSSRDEDLENCSHHL

Human IL-15Rα, extracellular domain

>sp|Q13261|31-205 SEQ ID NO:8
ITCPPPMSVEHADIWVKSYSLYSRERYICNSGFKRKAGTSSLTECVLNKATNVAHWTTPSLKCIRDPALVHQRPA
PPSTVTTAGVTPQPESLSPSGKEPAASSPSSNNTAATTAAIVPGSQLMPSKSPSTGTTEISSHESSHGTPSQTTA
KNWELTASASHQPPGVYPQGHSDTT

Human IL-15Rα, sushi domain

>sp|Q13261|31-95 SEQ ID NO:9
ITCPPPMSVEHADIWVKSYSLYSRERYICNSGFKRKAGTSSLTECVLNKATNVAHWTTPSLKCIR

Human IL-15Rß sequence

>sp|P14784 SEQ ID NO:10
MAAPALSWRLPLLILLLPLATSWASAAVNGTSQFTCFYNSRANISCVWSQDGALQDTSCQVHAWPDRRRWNQTCE
LLPVSQASWACNLILGAPDSQKLTTVDIVTLRVLCREGVRWRVMAIQDFKPFENLRLMAPISLQVVHVETHRCNI
SWEISQASHYFERHLEFEARTLSPGHTWEEAPLLTLKQKQEWICLETLTPDTQYEFQVRVKPLQGEFTTWSPWSQ
PLAFRTKPAALGKDTIPWLGHLLVGLSGAFGFIILVYLLINCRNTGPWLKKVLKCNTPDPSKFFSQLSSEHGGDV
QKWLSSPFPSSSFSPGGLAPEISPLEVLERDKVTQLLLQQDKVPEPASLSSNHSLTSCFTNQGYFFFHLPDALEI
EACQVYFTYDPYSEEDPDEGVAGAPTGSSPQPLQPLSGEDDAYCTFPSRDDLLLFSPSLLGGPSPPSTAPGGSGA
GEERMPPSLQERVPRDWDPQPLGPPTPGVPDLVDFQPPPELVLREAGEEVPDAGPREGVSFPWSRPPGQGEFRAL
NARLPLNTDAYLSLQELQGQDPTHLV

Human IL-15Rß, extracellular domain

>sp|P14784|27-240 SEQ ID NO:11
AVNGTSQFTCFYNSRANISCVWSQDGALQDTSCQVHAWPDRRRWNQTCELLPVSQASWACNLILGAPDSQKLTTV
DIVTLRVLCREGVRWRVMAIQDFKPFENLRLMAPISLQVVHVETHRCNISWEISQASHYFERHLEFEARTLSPGH
TWEEAPLLTLKQKQEWICLETLTPDTQYEFQVRVKPLQGEFTTWSPWSQPLAFRTKPAALGKDT

Figure 3B

Human common gamma chain sequence

>sp|P31785 SEQ ID NO:12
MLKPSLPFTSLLFLQLPLLGVGLNTTILTPNGNEDTTADFFLTTMPTDSLSVSTLPLPEVQCFVFNVEYMNCTWN
SSSEPQPTNLTLHYWYKNSDNDKVQKCSHYLFSEEITSGCQLQKKEIHLYQTFVVQLQDPREPRRQATQMLKLQN
LVIPWAPENLTLHKLSESQLELNWNNRFLNHCLEHLVQYRTDWDHSWTEQSVDYRHKFSLPSVDGQKRYTFRVRS
RFNPLCGSAQHWSEWSHPIHWGSNTSKENPFLFALEAVVISVGSMGLIISLLCVYFWLERTMPRIPTLKNLEDLV
TEYHGNFSAWSGVSKGLAESLQPDYSERLCLVSEIPPKGGALGEGPGASPCNQHSPYWAPPCYTLKPET

Human common gamma chain, extracellular domain

>sp|P31785|23-262 SEQ ID NO:13
LNTTILTPNGNEDTTADFFLTTMPTDSLSVSTLPLPEVQCFVFNVEYMNCTWNSSSEPQPTNLTLHYWYKNSDND
KVQKCSHYLFSEEITSGCQLQKKEIHLYQTFVVQLQDPREPRRQATQMLKLQNLVIPWAPENLTLHKLSESQLEL
NWNNRFLNHCLEHLVQYRTDWDHSWTEQSVDYRHKFSLPSVDGQKRYTFRVRSRFNPLCGSAQHWSEWSHPIHWG
SNTSKENPFLFALEA

Figure 4A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 4B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 4C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 4D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 4E

| Monomer 1 | Monomer 2 |
|---|---|
| K392D/K409D | E356K/D399K |
| K370D/K392D/K409D | E356K/E357K/D399K |
| I199T/N203D/K247Q/R355Q/N384S/K392N/V397M/Q419E/K447_ | Q196K/I199T/P217R/P228R/N276K |
| I199T/N203D/K247Q/R355Q/N384S/K392N/V397M/Q419E/K447_ | Q196K/I199T/N276K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| I199T/N203D/K247Q/R355Q/Q419E/K447_ | Q196K/I199T/P217R/P228R/N276K |
| I199T/N203D/K247Q/R355Q/Q419E/K447_ | Q196K/I199T/N276K |
| K247Q/R355Q/Q419E/K447_ | P217R/P228R/N276K |
| K247Q/R355Q/Q419E/K447_ | N276K |
| I199T/N203D/K274Q/R355Q/N384S/K392N/V397M/Q419E/K447_ | |
| N208D/Q295E/N384D/Q418E/N421D | |
| N208D/Q295E/Q418E/N421D | |
| Q196K/I199T/P217R/P228R/N276K | |
| Q196K/I199T/N276K | |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 5

| Variant constant region | Substitutions |
|---|---|
| pI_ISO(-) | I199T/N203D/K274Q/R355Q/N384S/K392N/V397M/Q419E/K447_ |
| pI_ISO(-)-Fc only | K274Q/R355Q/N384S/K392N/V397M/Q419E/K447_ |
| pI_(-)_isosteric A | N208D/Q295E/N384D/Q418E/N421D |
| pI_(-)_isosteric A-Fc only | Q295E/N384D/Q418E/N421D |
| pI_(-)_isosteric_B | N208D/Q295E/Q418E/N421D |
| pI_(-)_isosteric_B-Fc only | Q295E/Q418E/N421D |
| pI_ISO(+RR) | Q196K/I199T/P217R/P228R/N276K |
| pI_ISO(+RR)-Fc only | P217R/P228R/N276K |
| pI_ISO(+) | Q196K/I199T/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 6

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 7A

| IL-15-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7B

| scIL-15/Rα-Fc monomer (-) | empty-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7C

| empty-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 7D

| IL-15Rα(sushi)-Fc Chain 1 | IL-15Rα(sushi)-Fc Chain 2 |
|---|---|
| C220S | C220S |
| FcKO E233P/L234V/L235A/G236_/S267K | FcKO E233P/L234V/L235A/G236_/S267K |
| ±M428L/N434S | ±M428L/N434S |

Figure 7E

| Fc-IL-15Rα(sushi) (-) | IL-15Rα(sushi)-Fc monomer (+) |
|---|---|
| C220S | C220S |
| Heterodimer pI variants L368D/K370S | Heterodimer pI variants S364K/E357Q |
| | Isosteric pI substitutions P217R/P228R/N276K |
| FcKO E233P/L234V/L235A/G236_/S267K | FcKO E233P/L234V/L235A/G236_/S267K |
| ±M428L/N434S | ±M428L/N434S |

Figure 8A

| scIL-15/Rα-Fc monomer (-) | scFv-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 8B

| scFv-Fc monomer (-) | IL-15Rα(sushi)-Fc monomer (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 8C

| scIL-15/Rα-Fc monomer (-) | Heavy Chain (+) |
|---|---|
| C220S | |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 8D

| Heavy Chain (-) | IL-15Rα(sushi)-Fc monomer (+) |
|---|---|
| | C220S |
| Heterodimer pI variants L368D/K370S | Heterodimer pI variants S364K/E357Q |
| Isosteric pI substitutions N208D/Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 8E

| Heavy Chain-IL-15Rα(sushi) (-) | Heavy Chain (+) |
|---|---|
| Heterodimer pI variants L368D/K370S | Heterodimer pI variants S364K/E357Q |
| Isosteric pI substitutions N208D/Q295E/N384D/Q418E/N421D | Isosteric pI subsitutions Q196K/I199T/P217R/P228R/N276K |
| FcKO E233P/L234V/L235A/G236_/S267K | FcKO E233P/L234V/L235A/G236_/S267K |
| ±M428L/N434S | ±M428L/N434S |

Figure 8F

| Heavy Chain (-) | Heavy Chain-IL-15Rα(sushi) (+) |
|---|---|
| Heterodimer pI variants L368D/K370S | Heterodimer pI variants S364K/E357Q |
| Isosteric pI substitutions N208D/Q295E/N384D/Q418E/N421D | Isosteric pI subsitutions Q196K/I199T/P217R/P228R/N276K |
| FcKO E233P/L234V/L235A/G236_/S267K | FcKO E233P/L234V/L235A/G236_/S267K |
| ±M428L/N434S | ±M428L/N434S |

Figure 9

| Name | Sequence | SEQ ID NO: |
|---|---|---|
| (GGGGS)$_1$ or GGGGS | GGGGS | 14 |
| (GGGGS)$_2$ | GGGGSGGGGS | 15 |
| (GGGGS)$_3$ | GGGGSGGGGSGGGGS | 16 |
| (GGGGS)$_4$ | GGGGSGGGGSGGGGSGGGGS | 17 |
| (GGGGS)$_5$ | GGGGSGGGGSGGGGSGGGGSGGGGS | 18 |
| (GGGGS)$_6$ | GGGGSGGGGSGGGGSGGGGSGGGGSGGGGS | 19 |
| (GGGGS)$_7$ | GGGGSGGGGSGGGGSGGGGSGGGGSGGGGSGGGGS | 20 |
| 30AA-linker | DPALVHQRPAPPGGGGSGGGGSGGGGSGGG | 21 |
| (GKPGS)$_1$ or GKPGS | GKPGS | 22 |
| (GKPGS)$_5$ | GKPGSGKPGSGKPGSGKPGSGKPGS | 23 |
| (GKPGS)$_6$ | GKPGSGKPGSGKPGSGKPGSGKPGSGKPGS | 24 |
| (GGGES)$_1$ or GGGES | GGGES | 25 |

Figure 10

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | 26 |
| Whitlow linker | GSTSGSGKPGSGEGSTKG | 18 | +1 | 27 |
| 6paxA_1 (+A) | IRPRAIGGSKPRVA | 14 | +4 | 28 |
| +B | GKGGSGKGGSGKGGS | 15 | +3 | 29 |
| +C | GGKGSGGKGSGGKGS | 15 | +3 | 30 |
| +D | GGGKSGGGKSGGGKS | 15 | +3 | 31 |
| +E | GKGKSGKGKSGKGKS | 15 | +6 | 32 |
| +F | GGGKSGGKGSGKGGS | 15 | +3 | 33 |
| +G | GKPGSGKPGSGKPGS | 15 | +3 | 34 |
| +H | GKPGSGKPGSGKPGSGKPGS | 20 | +4 | 35 |
| +I | GKGKSGKGKSGKGKSGKGKS | 20 | +8 | 36 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | 37 |
| 3hsc_2 (-A) | STAGDTHLGGEDFD | 14 | -4 | 38 |
| -B | GEGGSGEGGSGEGGS | 15 | -3 | 39 |
| -C | GGEGSGGEGSGGEGS | 15 | -3 | 40 |
| -D | GGGESGGGESGGGES | 15 | -3 | 41 |
| -E | GEGESGEGESGEGES | 15 | -6 | 42 |
| -F | GGGESGGEGSGEGGS | 15 | -3 | 43 |
| -G | GEGESGEGESGEGESGEGES | 20 | -8 | 44 |

Additional scFv Linkers

| | |
|---|---|
| GGGGSGGGGSGGGGS | SEQ ID NO:45 |
| GGGGSGGGGSGGGGSGGGGS | SEQ ID NO:46 |
| GSTSGSGKPGSGEGSTKG | SEQ ID NO:47 |
| PRGASKSGSASQTGSAPGS | SEQ ID NO:48 |
| GTAAAGAGAAGGAAAGAAG | SEQ ID NO:49 |
| GTSGSSGSGSGGSGSGGG | SEQ ID NO:50 |
| GKPGSGKPGSGKPGSGKPGS | SEQ ID NO:51 |

Figure 11A

IL-15/Rα-Fc Backbone 1

\>IL-15/Rα-Fc monomer 1 (SEQ ID NO:52)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO:53)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 2

\>IL-15/Rα-Fc monomer 1 (SEQ ID NO:54)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO:55)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 3

\>IL-15/Rα-Fc monomer 1 (SEQ ID NO:56)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK \>IL-15/Rα-Fc monomer 2 (SEQ ID NO:57)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CEVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 4

\>IL-15/Rα-Fc monomer 1 (SEQ ID NO:58)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSKGSFFLYSKLTVDKSRWQQGNVFSCSVMHEALHNHYTQKSL
SLSPGK \>IL-15/Rα-Fc monomer 2 (SEQ ID NO:59)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTENEVSLT
CLVKGFYPSDIAVEWESDGQPENNYKTTPPVLDSDGSFFLYSKLEVDKSRWEQGDVFSCSVMHEALHNHYTQKSL
SLSPGK

Figure 11B

IL-15/Rα-Fc Backbone 5

>IL-15/Rα-Fc monomer 1 (SEQ ID NO:60)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSRDQLTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO:61)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSRDELTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 6

>IL-15/Rα-Fc monomer 1 (SEQ ID NO:62)
EPKSSDKTHTCPPCPAPPVAGPSVFLFPPKPKDTLMISRTPEVTCVVVDVKHEDPEVKFNWYVDGVEVHNAKTKP
REEQYASTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO:63)
EPKSSDKTHTCPPCPAPPVAGPSVFLFPPKPKDTLMISRTPEVTCVVVDVKHEDPEVKFNWYVDGVEVHNAKTKP
REEEYASTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 7

>IL-15/Rα-Fc monomer 1 (SEQ ID NO:64)
EPKSSDKTHTCPPCPAPPVAGPSVFLFPPKPKDTLMISRTPEVTCVVVDVKHEDPEVKFNWYVDGVEVHNAKTKP
REEQYSSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO:65)
EPKSSDKTHTCPPCPAPPVAGPSVFLFPPKPKDTLMISRTPEVTCVVVDVKHEDPEVKFNWYVDGVEVHNAKTKP
REEEYSSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

IL-15/Rα-Fc Backbone 8

>IL-15/Rα-Fc monomer 1 (SEQ ID NO:66)
ESKYGPPCPPCPAPEFLGGPSVFLFPPKPKDTLMISRTPEVTCVVVDVSQEDPEVQFNWYVDGVEVHNAKTKPRE
EQFNSTYRVVSVLTVLHQDWLNGKEYKCKVSNKGLPSSIEKTISKAKGQPREPQVYTLPPSQEQMTKNQVKLTCL
VKGFYPSDIAVEWESNGQPENNYKTTPPVLDSDGSFFLYSRLTVDKSRWQEGNVFSCSVMHEALHNHYTQKSLSL
SLGK >IL-15/Rα-Fc monomer 2 (SEQ ID NO:67)
ESKYGPPCPPCPAPEFLGGPSVFLFPPKPKDTLMISRTPEVTCVVVDVSQEDPEVQFNWYVDGVEVHNAKTKPRE
EEFNSTYRVVSVLTVLHQDWLNGKEYKCKVSNKGLPSSIEKTISKAKGQPREPQVYTLPPSQEEMTKNQVSLTCD
VSGFYPSDIAVEWESDGQPENNYKTTPPVLDSDGSFFLYSRLTVDKSRWEEGDVFSCSVMHEALHNHYTQKSLSL
SLGK

Figure 11C

IL-15/Rα-Fc Backbone 9

>IL-15/Rα-Fc monomer 1 (SEQ ID NO:68)
ERKCCVECPPCPAPPVAGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >IL-15/Rα-Fc monomer 2 (SEQ ID NO:69)
ERKCCVECPPCPAPPVAGPSVFLFPPKPKDTLMISRTPEVTCVVVDVSHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 10

>IL-15/Rα-Fc monomer 1 (SEQ ID NO:70)
ERKCCVECPPCPAPPVAGPSVFLFPPKPKDTLMISRTPEVTCVVVDVKHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >IL-15/Rα-Fc monomer 2 (SEQ ID NO:71)
ERKCCVECPPCPAPPVAGPSVFLFPPKPKDTLMISRTPEVTCVVVDVKHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

IL-15/Rα-Fc Backbone 11

>IL-15/Rα-Fc monomer 1 (SEQ ID NO:72)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK >IL-15/Rα-Fc monomer 2 (SEQ ID NO:73)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVLHEALHSHYTQKSL
SLSPGK

IL-15/Rα-Fc Backbone 12

>IL-15/Rα-Fc monomer 1 (SEQ ID NO:74)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK >IL-15/Rα-Fc monomer 2 (SEQ ID NO:75)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK

Figure 11D

<ins>IL-15/Rα-Fc Backbone 13</ins>

>IL-15/Rα-Fc monomer 1 (SEQ ID NO:76)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK >IL-15/Rα-Fc monomer 2 (SEQ ID NO:77)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 12

IL-15/Rα x anti-PD-1 Backbone 1

>Chain 1 (SEQ ID NO:78)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK >Chain 2 (SEQ ID NO:79)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

IL-15/Rα x anti-PD-1 Backbone 2

>Chain 1 (SEQ ID NO:80)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK >Chain 2 (SEQ ID NO:81)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

IL-15/Rα x anti-PD-1 Backbone 3

>Chain 1 (SEQ ID NO:82)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK >Chain 2 (SEQ ID NO:83)
ASTKGPSVFPLAPSSKSTSGGTAALGCLVKDYFPEPVTVSWNSGALTSGVHTFPAVLQSSGLYSLSSVVTVPSSSLGTKTYTCNVNHKPS
NTKVDKKVERKSCDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Figure 13

Constant Light Chain – Kappa SEQ ID NO:84
RTVAAPSVFIFPPSDEQLKSGTASVVCLLNNFYPREAKVQWKVDNALQSGNSQESVTEQDSKDSTYSLSSTLTLSKADYEKHKVYACEVT
HQGLSSPVTKSFNRGEC

Constant Light Chain – Lambda SEQ ID NO:85
GQPKAAPSVTLFPPSSEELQANKATLVCLISDFYPGAVTVAWKADSSPVKAGVETTTPSKQSNNKYAASSYLSLT
PEQWKSHRSYSCQVTHEGSTVEKTVAPTECS

Figure 14

>1G6_H1L1 Variable Heavy SEQ ID NO:86
EVQLVESGGGLVKPGGSLRLSCAASGFTFSNYWMNWVRQAPGKGLEWVGEIRLKSNNYATHYAEPVKGRFTISRD
DSKSTVYLQMNSLKTEDTAVYYCTRYYGNYGGYFDVWGAGTLVTVSS

>1G6_H1L1 Variable Light SEQ ID NO:87
SIVMTQSPATLSVSPGERATLSCRASQSVSNDVAWYQQKPGQSPRLLINYASHRYTGVPDRFTGSGYGTEFTLTI
SSLQSEDFAVYFCQQDYSSPPTFGGGTKVEIK

>1G6_H1.279_L1.194 Variable Heavy SEQ ID NO:88
EVQLVESGGGLVKPGGSLRLSCVASGFTFSNYWMNWVRQAPGKGLEWVAEIRLYSNNYATHYAESVKGRFTISRD
DSKSTLYLQMNNLKTEDTGVYYCTRYYGNYGGYFDVWGRGTLVTVSS

>1G6_H1.279_L1.194 Variable Light SEQ ID NO:89
EIVLTQSPATLSASPGERVTLTCRASQSVGNDVAWYQQKPGQAPRLLINYASHRYTGVPDRFTGSGYGTEFTLTI
SSVQSEDFGVYYCQQDFSSPRTFGGGTKVEIK

Figure 15A

>pembrolizumab[PD-1] Variable Heavy SEQ ID NO:90
QVQLVQSGVEVKKPGASVKVSCKASGYTFTNYYMYWVRQAPGQGLEWMGGINPSNGGTNFNEKFKNRVTLTTDSS
TTTAYMELKSLQFDDTAVYYCARRDYRFDMGFDYWGQGTTVTVSS

>pembrolizumab[PD-1] Variable Light SEQ ID NO:91
EIVLTQSPATLSLSPGERATLSCRASKGVSTSGYSYLHWYQQKPGQAPRLLIYLASYLESGVPARFSGSGSGTDF
TLTISSLEPEDFAVYYCQHSRDLPLTFGGGTKVEIK

>nivolumab[PD-1] Variable Heavy SEQ ID NO:92
QVQLVESGGGVVQPGRSLRLDCKASGITFSNSGMHWVRQAPGKGLEWVAVIWYDGSKRYYADSVKGRFTISRDNS
KNTLFLQMNSLRAEDTAVYYCATNDDYWGQGTLVTVSS

>nivolumab[PD-1] Variable Light SEQ ID NO:93
EIVLTQSPATLSLSPGERATLSCRASQSVSSYLAWYQQKPGQAPRLLIYDASNRATGIPARFSGSGSGTDFTLTI
SSLEPEDFAVYYCQQSSNWPRTFGQGTKVEIK

>pidilizumab[PD-1] Variable Heavy SEQ ID NO:94
QVQLVQSGSELKKPGASVKISCKASGYTFTNYGMNWVRQAPGQGLQWMGWINTDSGESTYAEEFKGRFVFSLDTS
VNTAYLQITSLTAEDTGMYFCVRVGYDALDYWGQGTLVTVSS

>pidilizumab[PD-1] Variable Light SEQ ID NO:95
EIVLTQSPSSLSASVGDRVTITCSARSSVSYMHWFQQKPGKAPKLWIYRTSNLASGVPSRFSGSGSGTSYCLTIN
SLQPEDFATYYCQQRSSFPLTFGGGTKLEIK

>MK-3475[PD-1] Variable Heavy SEQ ID NO:96
QVQLVQSGVEVKKPGASVKVSCKASGYTFTNYYMYWVRQAPGQGLEWMGGINPSNGGTNFNEKFKNRVTLTTDSS
TTTAYMELKSLQFDDTAVYYCARRDYRFDMGFDYWGQGTTVTVSS

>MK-3475[PD-1] Variable Light SEQ ID NO:97
EIVLTQSPATLSLSPGERATLSCRASKGVSTSGYSYLHWYQQKPGQAPRLLIYLASYLESGVPARFSGSGSGTDF
TLTISSLEPEDFAVYYCQHSRDLPLTFGGGTKVEIK

>BAP049 Clone E[PD-1] Variable Heavy SEQ ID NO:98
EVQLVQSGAEVKKPGESLRISCKGSGYTFTTYWMHWVRQATGQGLEWMGNIYPGTGGSNFDEKFKNRVTITADKS
TSTAYMELSSLRSEDTAVYYCTRWTTGTGAYWGQGTTVTVSS

>BAP049 Clone E[PD-1] Variable Light SEQ ID NO:99
EIVLTQSPATLSLSPGERATLSCKSSQSLLDSGNQKNFLTWYQQKPGQAPRLLIYWASTRESGVPSRFSGSGSGT
DFTFTISSLEAEDAATYYCQNDYSYPYTFGQGTKVEIK

>BAP049 Clone B[PD-1] Variable Heavy SEQ ID NO:100
EVQLVQSGAEVKKPGESLRISCKGSGYTFTTYWMHWVRQATGQGLEWMGNIYPGTGGSNFDEKFKNRVTITADKS
TSTAYMELSSLRSEDTAVYYCTRWTTGTGAYWGQGTTVTVSS

>BAP049 Clone B[PD-1] Variable Light SEQ ID NO:101
EIVLTQSPATLSLSPGERATLSCKSSQSLLDSGNQKNFLTWYQQKPGKAPKLLIYWASTRESGVPSRFSGSGSGT
DFTFTISSLQPEDIATYYCQNDYSYPYTFGQGTKVEIK

>H7798N[PD-1] Variable Heavy SEQ ID NO:102
EVQLLESGGGVLVQPGGSLRLSCAASGFTFSNFGMTWVRQAPGKGLEWVSGISGGGRDTYFADSVKGRFTISRDNS
KNTLYLQMNSLKGEDTAVYYCVKWGNIYFDYWGQGTLVTVSS

Figure 15B

>H7709N[PD-1] Variable Light SEQ ID NO:103
DIQMTQSPSSLSASVGDSITITCRASLSINTFLNWYQQKPGKAPNLLIYAASSLHGGVPSRFSGSGSGTDFTLTI
RTLQPEDFATYYCQQSSNTPFTFGPGTVVDFR

>h1H3 Var 6[PD-1] Variable Heavy SEQ ID NO:104
EVQLVESGGGLVQPGGSLRLSCAASGFTFSDYGMHWVRQAPGKGLEWVAYISSGSYTIYYADSVKGRFTISRDNA
KNTLYLQMSSLRAEDTAVYYCARRGYGSFYEYYFDYWGQGTTVTVSS

>h1H3 Var 6[PD-1] Variable Light SEQ ID NO:105
QIVLTQSPATLSLSPGERATLSCSASSSVSYMYWYQQKPGQAPRLLIYLTSNRATGIPARFSGSGSGTDYTLTIS
SLEPEDFAVYYCQQWSSNPFTFGQGTKLEIK

>APE2058[PD-1] Variable Heavy SEQ ID NO:106
EVQLLESGGGLVQPGGSLRLSCAASGFTFSSYDMSWVRQAPGKGLEWVSTISGGGSYTYYQDSVKGRFTISRDNS
KNTLYLQMNSLRAEDTAVYYCASPYYAMDYWGQGTTVTVSSA

>APE2058[PD-1] Variable Light SEQ ID NO:107
DIQLTQSPSFLSAYVGDRVTITCKASQDVGTAVAWYQQKPGKAPKLLIYWASTLHTGVPSRFSGSGSGTEFTLTI
SSLQPEDFATYYCQHYSSYPWTFGQGTKLEIKR

>H005-1[PD-1] Variable Heavy SEQ ID NO:108
EVQLVESGGGLVQPGGSLRLSCAASGFTFSSYMMSWVRQAPGKGLEWVATISGGGANTYYPDSVKGRFTISRDNA
KNSLYLQMNSLRAEDTAVYYCARQLYYFDYWGQGTTVTVSS

>H005-1[PD-1] Variable Light SEQ ID NO:109
DIQMTQSPSSLSASVGDRVTITCLASQTIGTWLTWYQQKPGKAPKLLIYTATSLADGVPSRFSGSGSGTDFTLTI
SSLQPEDFATYYCQQVYSIPWTFGGGTKVEIK

>317-4B6[PD-1] Variable Heavy SEQ ID NO:110
QVQLQESGPGLVKPSETLSLTCTVSGFSLTSYGVHWIRQPPGKGLEWIGVIYADGSTNYNPSLKSRVTISKDTSK
NQVSLKLSSVTAADTAVYYCARAYGNYWYIDVWGQGTTVTVSS

>317-4B6[PD-1] Variable Light SEQ ID NO:111
DIVMTQSPDSLAVSLGERATINCKSSESVSNDVAWYQQKPGQPPKLLINYAFHRFTGVPDRFSGSGYGTDFTLTI
SSLQAEDVAVYYCHQAYSSPYTFGQGTKLEIK

>326-4A3[PD-1] Variable Heavy SEQ ID NO:112
QVQLVQSGSELKKPGASVKVSCKASGYTFTNYGMNWVRQAPGQGLKWMGWINNNNAEPTYAQDFPGRFVFSLDTS
ASTAYLQISSLKTEDTAVYYCARDVMDYWGQGTLVTVSS

>326-4A3[PD-1] Variable Light SEQ ID NO:113
DIVLTQSPASLAVSPGQRATITCRASESVDNYGYSFMHWYQQKPGQPPKLLIYRASNLESGVPARFSGSGSGTDF
TLTINPVEAEDTANYYCQQSKEYPTFGGGTKVEIK

>hPD-1 mAb 7 (1.2)[PD-1] Variable Heavy SEQ ID NO:114
QVQLVQSGAEVKKPGASVKVSCKASGYSFTSYWMNWVRQAPGQGLEWIGVIHPSDSETWLDQKFKDRVTITVDKS
TSTAYMELSSLRSEDTAVYYCAREHYGTSPFAYWGQGTLVTVSS

>hPD-1 mAb 7 (1.2)[PD-1] Variable Light SEQ ID NO:115
EIVLTQSPATLSLSPGERATLSCRASESVDNYGMSFMNWFQQKPGQPPKLLIHAASNQGSGVPSRFSGSGSGTDF
TLTISSLEPEDFAVYFCQQSKEVPYTFGGGTKVEIK

Figure 15C

>Clone 38[PD-1] Variable Heavy SEQ ID NO:116
QGQLVQSGAEVKKPGASVKVSCKASGYTFTDYEMHWVRQAPIHGLEWIGVIESETGGTAYNQKFKGRVTITADKS
TSTAYMELSSLRSEDTAVYYCAREGITTVATTYYWYFDVWGQGTTVTVSS

>Clone 38[PD-1] Variable Light SEQ ID NO:117
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 39[PD-1] Variable Heavy SEQ ID NO:118
QGQLVQSGAEVKKPGASVKVSCKASGYTFTDYEMHWVRQAPGQGLEWMGVIESETGGTAYNQKFKGRAKITADKS
TSTAYMELSSLRSEDTAVYYCTREGITTVATTYYWYFDVWGQGTTVTVSS

>Clone 39[PD-1] Variable Light SEQ ID NO:119
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 41[PD-1] Variable Heavy SEQ ID NO:120
QGQLVQSGAEVKKPGASVKVSCKASGYTFTDYEMHWVRQAPGQGLEWMGVIESETGGTAYNQKFQGRVTLTADKS
SSTAYMELSSLRSEDTAVYYCTREGITTVATTYYWYFDVWGQGTLVTVSS

>Clone 41[PD-1] Variable Light SEQ ID NO:121
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 48[PD-1] Variable Heavy SEQ ID NO:122
QGQLVQSGAEVKKPGASVKVSCKASGYTFTDYEMHWVRQAPGQGLEWMGVIESETGGTAYNQKFKGRAKITADKS
TSTAYMELSSLRSEDTAVYYCTREGITTVATTYYWYFDVWGQGTTVTVSS

>Clone 48[PD-1] Variable Light SEQ ID NO:123
DVVMTQSPLSLPVTLGQPASISCRSSQSIVHSNGNTYLEWYLQKPGQSPRLLIYKVSNRFSGVPDRFSGSGSGTD
FTLKISRVEAEDVGVYYCFQGSHVPLTFGQGTKLEIK

>PD1-17[PD-1] Variable Heavy SEQ ID NO:124
QVQLQESGPGVVKPSGTLSLTCAISGGSIGSGGSIRSTRWWSWVRQSPGKGLEWIGEIYHSGSTNYNPSLKSRVT
ISLDKSRNHFSLRLNSVTAADTAVYYCARQDYGDSGDWYFDLWGKGTMVTVSS

>PD1-17[PD-1] Variable Light SEQ ID NO:125
NFMLTQPHSVSESPGKTVTISCTRSSGSIASNSVQWYQQRPGSSPTTVIYEDNQRPSGVPDRFSGSIDSSSNSAS
LTVSGLKTEDEADYYCQSSDSSAVVFGSGTKLTVL

>PD1-28[PD-1] Variable Heavy SEQ ID NO:126
EVQLVQSGAEVKKPGASVKVSCKASGYRFTSYGISWVRQAPGQGLEWMGWISAYNGNTNYAQKLQGRVTMTTDTS
TNTAYMELRSLRSDDTAVYYCARDADYSSGSGYWGQGTLVTVSS

>PD1-28[PD-1] Variable Light SEQ ID NO:127
SYELTQPPSVSVSPGQTARITCSGDALPKQYAYWYQQKPGQAPVMVIYKDTERPSGIPERFSGSSSGTKVTLTIS
GVQAEDEADYYCQSADNSITYRVFGGGTKVTVL

>PD1-33[PD-1] Variable Heavy SEQ ID NO:128
QVQLVQSGAEVKKPGASVRVSCKASGYTLTSYYIHWVRQAPGQGLEWMGIINPRGATISYAQKFQGRVTMTRDTS
TSTVYMELRNLKSEDTALYYCATAGIYGFDFDYWGRGTLVTVSS

Figure 15D

>PD1-33[PD-1] Variable Light SEQ ID NO:129
QSALTQPASVSGSPGQSITISCTGTSNDVGGYNYVSWYQHHPGKAPKLIIYDVTNRPSGVSDRFSGSKSGNTASL
TISGLLAEDEGDYYCSSYTLVTNFEVLFGGGTKLTV

>PD1-35[PD-1] Variable Heavy SEQ ID NO:130
QVQLQESGPGLVKPSQTLSLTCTVSGGSISSGAYYWSWIRQHPGKGLEWIGYIYYNGNTYYNPSLRSLVTISVDA
SKNQFSLKLSSVTAADTAVYYCARASDYVWGGYRYMDAFDIWGRGTLITVSS

>PD1-35[PD-1] Variable Light SEQ ID NO:131
QSVLTQPPSASGTPGQRVTISCSGSNSNIGSNSVNWYQQLPGTAPKLLIYGNNQRPSGVPDRFSGSKSGTSASLA
ISGLQSENEADYYCAAWDDSLNGPVFGRGTKVTVLGE

>LOPD180[PD-1] Variable Heavy SEQ ID NO:132
QVQLQESGPGLVKPSQTLSLTCTVSGGSISSGAYYWSWIRQHPGKGLEWIGYIYYNGNTYYNPSLRSRVTISVDT
SKNQFSLKLSSVTAADTAVYYCVRASDYVWGGYRYFDAFDLWGRGTLVTVSS

>LOPD180[PD-1] Variable Light SEQ ID NO:133
QSVLTQPPSASGTPGQRVTISCSGSNSNIGSNSVNWYQQLPGTAPKLLIYGNNQRPSGVPDRFSGSKSGTSASLA
ISGLQSEDEADYYCAAWDDSLNGPVFGGGTKVTVL

>Ab948[PD-1] Variable Heavy SEQ ID NO:134
EVQLQESGPGLVKPSQTLSLTCTVTGYSITSDYAWNWIRQPPGKKLEWMGYINYSGSTSYNPSLKSRVTISRDTS
KNQFSLKLSSVTAADTAVYYCARWIGSSAWYFDVWGQGTLVTVS

>Ab948[PD-1] Variable Light SEQ ID NO:135
DVLMTQTPLSLSVTPGQPASISCRSGQNIVHSNGNTYLEWYLQKPGQSPKLLIYKVSNRFFGVPDRISGSGSGTD
FTLKISRVEAEDVGVYFCFQGSHVPFTFGQGTKLEIK

>humanized EH-12.2H7[PD-1] Variable Heavy SEQ ID NO:136
QVQLVQSGHEVKQPGASVKMSCKASGYSFTSSWIHWVRQAPGQGLEWIGYIYPSTGFTEYNQKFKDRATLTADKS
TSTAYMELSSLRSEDTAVYYCARWRDSSGYHAMDYWGQGTLVTVSS

>humanized EH-12.2H7[PD-1] Variable Light SEQ ID NO:137
EIVLTQSPATLSLSPGQRLTISCRASQSVSTSGYSYMHWYQQKPDQSPKLLIKFGSNLESGIPARFSGSGSGTDF
TLTISSLEPEDFATYYCQHSWEIPYTFGQGTKLEIK

>RG1H10[PD-1] Variable Heavy SEQ ID NO:138
QVQLVQSGSELKKPGASVKISCKASGYIFSDNGVNWVRQAPGQGLEWMGWINTKIGNPTYAQGFTGRFVFSLDTS
ISTTYLQISSLQAGDTAVYYCAREHDYYYGMDVWGQGTTVTVSS

>RG1H10[PD-1] Variable Light SEQ ID NO:139
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-H2A-22-1S[PD-1] Variable Heavy SEQ ID NO:140
QVQLVQSGSELKKPGASVKISCKASGYIFSDNGVNWVRQAPGQGLEWMGWINTKDGNPTYAQGFTGRFVFSLDTS
ISTTYLQISSLQAGDTAVYYCAREHDYYYGMDVWGQGTTVTVSS

>RG1H10-H2A-22-1S[PD-1] Variable Light SEQ ID NO:141
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

Figure 15E

>RG1H10-H2A-27-2S[PD-1] Variable Heavy SEQ ID NO:145
QVQLVQSGSELKKPGASVKISCKASGYIFSDNGVNWVRQAPGQGLEWMGWINTKTGNPTYAQGFTGRFVFSLDTS
ISTTYLQISSLQAGDTAVYYCAREHDYYYGMDVWGQGTTVTVSS

>RG1H10-H2A-27-2S[PD-1] Variable Light SEQ ID NO:146
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-3C[PD-1] Variable Heavy SEQ ID NO:147
QVQLVQSGSELKKPGASVKISCKASGYTFSDNGVNWVRQAPGQGLEWMGWINTKDGNPTYAQGFTGRFVFSLDTS
ISTTYLQISSLQAGDTAVYYCAREHDYYYGMDVWGQGTTVTVSS

>RG1H10-3C[PD-1] Variable Light SEQ ID NO:148
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-16C[PD-1] Variable Heavy SEQ ID NO:149
QVQLVQSGSELKKPGASVKISCKASGYTFSDNGVNWVRQAPGQGLEWMGWINTKTGNPTYAQGFTGRFVFSLDTS
ISTTYLQISSLQAGDTAVYYCAREHDYYYGMDVWGQGTTVTVS

>RG1H10-16C[PD-1] Variable Light SEQ ID NO:150
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-17C[PD-1] Variable Heavy SEQ ID NO:151
QVQLVQSGSELKKPGASVKISCKASGYKFSDNGVNWVRQAPGQGLEWMGWINTKSGNPTYAQGFTGRFVFSLDTS
ISTTYLQISSLQAGDTAVYYCAREHDYYYGMDVWGQGTTVTVSS

>RG1H10-17C[PD-1] Variable Light SEQ ID NO:152
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-19C[PD-1] Variable Heavy SEQ ID NO:153
QVQLVQSGSELKKPGASVKISCKASGYKFSDNGVNWVRQAPGQGLEWMGWINTKTGNPTYAQGFTGRFVFSLDTS
ISTTYLQISSLQAGDTAVYYCAREHDYYYGMDVWGQGTTVTVSS

>RG1H10-19C[PD-1] Variable Light SEQ ID NO:154
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>RG1H10-21C[PD-1] Variable Heavy SEQ ID NO:155
QVQLVQSGSELKKPGASVKISCKASGYTFSDNGVNWVRQAPGQGLEWMGWINTKSGNPTYAQGFTGRFVFSLDTS
ISTTYLQISSLQAGDTAVYYCAREHDYYYGMDVWGQGTTVTVSS

>RG1H10-21C[PD-1] Variable Light SEQ ID NO:156
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

Figure 15F

>RG1H10-23C2[PD-1] Variable Heavy SEQ ID NO:157
QVQLVQSGSELKKPGASVKISCKASGYKFSDNGVNWVRQAPGQGLEWMGWINTKDGNPTYAQGFTGRFVFSLDTS
ISTTYLQISSLQAGDTAVYYCAREHDYYYGMDVWGQGTTVTVSS

>RG1H10-23C2[PD-1] Variable Light SEQ ID NO:158
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

>mAb7[PD-1] Variable Heavy SEQ ID NO:159
QVQLVQSGAEVKKPGASVKVSCKASGYTFTSYWINWVRQAPGQGLEWMGNIYPGSSLTNYNEKFKNRVTMTRDTS
TSTVYMELSSLRSEDTAVYYCARLSTGTFAYWGQGTLVTVSS

>mAb7[PD-1] Variable Light SEQ ID NO:160
DIVMTQSPDSLAVSLGERATINCKSSQSLWDSGNQKNFLTWYQQKPGQPPKLLIYWTSYRESGVPDRFSGSGSGT
DFTLTISSLQAEDVAVYYCQNDYFYPHTFGGGTKVEIK

>PD1AB-6[PD-1] Variable Heavy SEQ ID NO:161
EVQLVQSGAEVKKPGATVKISCKASGFNIKDTYMHWVQQAPGKGLEWMGRIDPANGDRKYDPKFQGRVTITADTS
TDTAYMELSSLRSEDTAVYYCARSGPVYYYGSSYVMDYWGQGTTVTVSS

>PD1AB-6[PD-1] Variable Light SEQ ID NO:162
DIVMTQSPDSLAVSLGERATINCKSGQSVLYSSNQKNFLAWYQQKPGQPPKLLIYWASTRESGVPDRFSGSGSGT
DFTLTISSLQAEDVAVYYCHQYLYSWTFGQGTKLEIKR

Figure 16

XENP021575 1C11[PD-1]_H0L0_IgG1_PVA_/S267K Heavy Chain SEQ ID NO:163
QIQLVQSGPELKKPGETVKISCRASGYTFTHYGMNWVKQAPGKGLKWMGWINTYTGEPTYADDFKGRFAFSLETSASTAYLQINNLKNED
TATYFCARDYYGSSPYWGQGTTLTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREEMTK
NQVSLTCLVKGFYPSDIAVEWESNGQPENNYKTTPPVLDSDGSFFLYSKLTVDKSRWQQGNVFSCSVMHEALHNHYTQKSLSLSPGK

XENP021575 1C11[PD-1]_H0L0_IgG1_PVA_/S267K Light Chain SEQ ID NO:164
DVLMTQTPLSLPVSLGDQASISCRSSQSIVHSNGNTYLEWYLQKPGQSPKLLIYKVSNRFSGVPDRFSGSGSGTDFTLKISRVEAEDLGV
YYCFQGSHVPNTFGGGTKLEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 20A

>XENP022543 1C11[PD-1]_H1L1_IgG1_PVA_/S267K Heavy Chain SEQ ID NO:166
QIQLVQSGAEVKKPGASVKVSCKASGYTFTHYGMNWVRQAPGQGLEWMGWINTYTGEPTYADKFQGRVTMTLDTS
TSTAYMELSSLRSEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022543 1C11[PD-1]_H1L1_IgG1_PVA_/S267K Light Chain SEQ ID NO:167
DVLMTQSPLSLPVTPGEPASISCRSSQSIVHSNGNTYLEWYLQKPGQSPQLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022544 1C11[PD-1]_H2L1_IgG1_PVA_/S267K Heavy Chain SEQ ID NO:168
EIQLLESGGGLVQPGGSLRLSCAASGYTFTHYGMNWVRQAPGKGLEWVSWINTYTGEPTYADSVKGRFTISLDTS
KSTAYLQMNSLRAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022544 1C11[PD-1]_H2L1_IgG1_PVA_/S267K Light Chain SEQ ID NO:169
DVLMTQSPLSLPVTPGEPASISCRSSQSIVHSNGNTYLEWYLQKPGQSPQLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022545 1C11[PD-1]_H3L1_IgG1_PVA_/S267K Heavy Chain SEQ ID NO:170
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022545 1C11[PD-1]_H3L1_IgG1_PVA_/S267K Light Chain SEQ ID NO:171
DVLMTQSPLSLPVTPGEPASISCRSSQSIVHSNGNTYLEWYLQKPGQSPQLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022546 1C11[PD-1]_H4L1_IgG1_PVA_/S267K Heavy Chain SEQ ID NO:172
EVQLLESGGGLVQPGGSLRLSCAASGYTFTHYGMNWVRQAPGKGLEWVSWINTYTGEPTYADSVKGRFTISLDTS
KSTAYLQMNSLRAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022546 1C11[PD-1]_H4L1_IgG1_PVA_/S267K Light Chain SEQ ID NO:173
DVLMTQSPLSLPVTPGEPASISCRSSQSIVHSNGNTYLEWYLQKPGQSPQLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 20B

>XENP022547 1C11[PD-1]_H1L2_IgG1_PVA_/S267K Heavy Chain SEQ ID NO:174
QIQLVQSGAEVKKPGASVKVSCKASGYTFTHYGMNWVRQAPGQGLEWMGWINTYTGEPTYADKFQGRVTMTLDTS
TSTAYMELSSLRSEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022547 1C11[PD-1]_H1L2_IgG1_PVA_/S267K Light Chain SEQ ID NO:175
DVLMTQSPLSLPVTLGQPASISCRSSQSIVHSNGNTYLEWYQQRPGQSPRLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022548 1C11[PD-1]_H2L2_IgG1_PVA_/S267K Heavy Chain SEQ ID NO:176
EIQLLESGGGLVQPGGSLRLSCAASGYTFTHYGMNWVRQAPGKGLEWVSWINTYTGEPTYADSVKGRFTISLDTS
KSTAYLQMNSLRAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022548 1C11[PD-1]_H2L2_IgG1_PVA_/S267K Light Chain SEQ ID NO:177
DVLMTQSPLSLPVTLGQPASISCRSSQSIVHSNGNTYLEWYQQRPGQSPRLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022549 1C11[PD-1]_H3L2_IgG1_PVA_/S267K Heavy Chain SEQ ID NO:178
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022549 1C11[PD-1]_H3L2_IgG1_PVA_/S267K Light Chain SEQ ID NO:179
DVLMTQSPLSLPVTLGQPASISCRSSQSIVHSNGNTYLEWYQQRPGQSPRLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022550 1C11[PD-1]_H4L2_IgG1_PVA_/S267K Heavy Chain SEQ ID NO:180
EVQLLESGGGLVQPGGSLRLSCAASGYTFTHYGMNWVRQAPGKGLEWVSWINTYTGEPTYADSVKGRFTISLDTS
KSTAYLQMNSLRAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022550 1C11[PD-1]_H4L2_IgG1_PVA_/S267K Light Chain SEQ ID NO:181
DVLMTQSPLSLPVTLGQPASISCRSSQSIVHSNGNTYLEWYQQRPGQSPRLLIYKVSNRFSGVPDRFSGSGSGTD
FTLKISRVEAEDVGVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 20C

>XENP022551 1C11[PD-1]_H1L3_IgG1_PVA_/S267K Heavy Chain SEQ ID NO:182
QIQLVQSGAEVKKPGASVKVSCKASGYTFTHYGMNWVRQAPGQGLEWMGWINTYTGEPTYADKFQGRVTMTLDTS
TSTAYMELSSLRSEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022551 1C11[PD-1]_H1L3_IgG1_PVA_/S267K Light Chain SEQ ID NO:183
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022552 1C11[PD-1]_H2L3_IgG1_PVA_/S267K Heavy Chain SEQ ID NO:184
EIQLLESGGGLVQPGGSLRLSCAASGYTFTHYGMNWVRQAPGKGLEWVSWINTYTGEPTYADSVKGRFTISLDTS
KSTAYLQMNSLRAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022552 1C11[PD-1]_H2L3_IgG1_PVA_/S267K Light Chain SEQ ID NO:185
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022553 1C11[PD-1]_H3L3_IgG1_PVA_/S267K Heavy Chain SEQ ID NO:186
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain SEQ ID NO:187
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP022554 1C11[PD-1]_H4L3_IgG1_PVA_/S267K Heavy Chain SEQ ID NO:188
EVQLLESGGGLVQPGGSLRLSCAASGYTFTHYGMNWVRQAPGKGLEWVSWINTYTGEPTYADSVKGRFTISLDTS
KSTAYLQMNSLRAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022554 1C11[PD-1]_H4L3_IgG1_PVA_/S267K Light Chain SEQ ID NO:189
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

IL-15/Rα-heteroFc
Example: XENP20818 scIL-15/Rα-Fc
Example: XENP21478 ncIL-15/Rα-Fc
Example: XENP21479

Bivalent ncIL-15/Rα-Fc
Example: XENP21978

Bivalent scIL-15/Rα-Fc

Fc-ncIL-15/Rα
Example: XENP22637

Fc-scIL-15/Rα

Figure 23

>XENP20818 – human IL15-(GGGGS)₁ x human IL15Rα(Sushi)-(GGGGS)₁ Fc heterodimer

Chain 1 - human_IL15_(GGGGS)₁_Fc(216)_IgG1_pI(-)_Isosteric_A_C220S/PVA_/S267K/L368D/K370S (15902)
SEQ ID NO:190
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_C220S/PVA_/S267K/S364K/E357Q (15908) SEQ ID NO:191
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP21475 – human IL15 x human IL15Rα(Sushi) Fc heterodimer

Chain 1 - human_IL15-Fc(216)_IgG1_pI(-)_Isosteric_A_C220S/PVA_/S267K/L368D/K370S (16479) SEQ ID NO:192
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 - human_IL15Rα(Sushi)-Fc(216)_IgG1_C220S/PVA_/S267K/S364K/E357Q (16481) SEQ ID NO:193
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 24

>XENP21478 – human IL15Rα(Sushi)-(GGGGS)₆-human IL15(single-chain) Fc heterodimer Chain 1 - human_IL15Rα(sushi)_(GGGGS)₆-human_IL15-Fc(216)_IgG1_pI(-)_Isosteric_A_C220S/PVA_/S267K/L368D/K370S (16478) SEQ ID NO:194
ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 - empty-Fc(216)_IgG1_C220S/PVA_/S267K/S364K/E357Q (8924) SEQ ID NO:195
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 25A

>XENP21479 – empty-Fc-IL15(non-covalent)-human_IL15Rα(Sushi) Fc heterodimer

Chain 1 - human_IL15_no_tag (16484) SEQ ID NO:196
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) SEQ ID NO:197
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Rα(Sushi)-Fc(216)_IgG1_C220S/PVA_/S267K/S364K/E357Q (16481) SEQ ID NO:198
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

>XENP022366 – empty-Fc-IL15(non-covalent)-human_IL15Ra(sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_no_tag (16484) SEQ ID NO:199
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) SEQ ID NO:200
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi)_(GGGGS)1_Fc(216)_IgG1_C220S/PVA_/S267K/S364K/E357Q (15908) SEQ ID NO:201
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 25B

>XENP024348 IL15(non-covalent)-human_IL15Ra(Sushi)_empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 – IL15 WT SEQ ID NO:202
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS Chain 2 – human_IL15Ra(Sushi)_Fc(216)_IgG1_pI(-)_Isosteric_A_C220S/PVA_/S267K/L368D/K370S SEQ ID NO:203
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK Chain 3 – empty_Fc(216)_IgG1_C220S/PVA_/S267K/S364K/E357Q SEQ ID NO:204
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 26

>XENP021978 – human_IL15(non-covalent)-human_IL15Ra(Sushi)_Fc(216)_IgG1_C220S/PVA_/S267K

Chain 1 - human_IL15Ra(Sushi)-Fc(216)_IgG1_C220S/PVA_/S267K (17023) SEQ ID NO:205
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_no_tag (16484) SEQ ID NO:206
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 27 human_IL15(single-chain)-human_IL15Ra(Sushi)_Fc(216)_IgG1_C220S/PVA_/S267K SEQ ID NO:207

NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS/GGGGS/ITCPPPMSVEHADIWVKSYSLYSRERYIC
NSGFKRKAGTSSLTECVLNKATNVAHWTTPSLKCIR/EPKSSDKTHTCPPCPAPPVAGPSVFLFPPKPKDTLMIS
RTPEVTCVVVDVKHEDPEVKFNWYVDGVEVHNAKTKPREEQYNSTYRVVSVLTVLHQDWLNGKEYKCKVSNKALP
APIEKTISKAKGQPREPQVYTLPPSREEMTKNQVSLTCLVKGFYPSDIAVEWESNGQPENNYKTTPPVLDSDGSF
FLYSKLTVDKSRWQQGNVFSCSVMHEALHNHYTQKSLSLSPGK

Figure 28

>XENP022637 – empty-Fc(216)_IgG1_pI(-
)_Isosteric_A_C220S/PVA_/S267K/L368D/K370S_(GGGGS)2_IL15Ra(Sushi)_IL15(non-
covalent)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi)
(17603) SEQ ID NO:208
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR Chain 2 - empty-Fc(216)_IgG1_ISO(+RR)_C220S/PVA_/S267K/S364K/E357Q (8927) SEQ ID NO:209
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_no_tag (16484) SEQ ID NO:210
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVQMFINTS

Figure 29 empty-Fc(216)_IgG1_pI(-
)_Isosteric_A_C220S/PVA_/S267K/L368D/K370S_(GGGGS)2_IL15Ra(Sushi)_IL15(single-
chain)_IgG1_ISO(+RR)_C220S/PVA_/S267K/S364K/E357Q Chain 1 - empty-Fc(216)_IgG1_pI(-
)_Isosteric_A_C220S/PVA_/S267K/L368D/K370S_(GGGGS)2_IL15Ra(Sushi)_IL15(single-chain) SEQ ID
NO:211
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIR/GGGGS/NWVNVISDLKKIEDLIQSMHIDATLYTESDVHPSCKVTAMKCFLLELQVISLESGDASIH
DTVENLIILANNSLSSNGNVTESGCKECEELEEKNIKEFLQSFVHIVQMFINTS Chain 2 - empty-Fc(216)_IgG1_ISO(+RR)_C220S/PVA_/S267K/S364K/E357Q (8927) SEQ ID NO:212
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 33

<u>IL-15Rα(sushi-D96)</u> SEQ ID NO:213
ITCPPPMSVEHADIWVKSYSLYSRERYICNSGFKRKAGTSSLTECVLNKATNVAHWTTPSLKCIR<u>D</u>

<u>IL-15Rα(sushi-D96/P97)</u> SEQ ID NO:214
ITCPPPMSVEHADIWVKSYSLYSRERYICNSGFKRKAGTSSLTECVLNKATNVAHWTTPSLKCIR<u>DP</u>

<u>IL-15Rα(sushi-D96/P97/A98)</u> SEQ ID NO:215
ITCPPPMSVEHADIWVKSYSLYSRERYICNSGFKRKAGTSSLTECVLNKATNVAHWTTPSLKCIR<u>DPA</u>

Figure 34

IL-15(E87C) SEQ ID NO:216
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

IL-15(V49C) SEQ ID NO:217
NWVNVISDLKKIEDLIQSMHIDATLYTESDVHPSCKVTAMKCFLLELQCISLESGDASIHDTVENLIILANNSLS
SNGNVTESGCKECEELEEKNIKEFLQSFVHIVQMFINTS

IL-15(L52C) SEQ ID NO:218
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

IL-15(E89C) SEQ ID NO:219
NWVNVISDLKKIEDLIQSMHIDATLYTESDVHPSCKVTAMKCFLLELQVISLESGDASIHDTVENLIILANNSLS
SNGNVTESGCKECCELEEKNIKEFLQSFVHIVQMFINTS

IL-15(Q48C) SEQ ID NO:220
NWVNVISDLKKIEDLIQSMHIDATLYTESDVHPSCKVTAMKCFLLELCVISLESGDASIHDTVENLIILANNSLS
SNGNVTESGCKECEELEEKNIKEFLQSFVHIVQMFINTS

IL-15(E53C) SEQ ID NO:221
NWVNVISDLKKIEDLIQSMHIDATLYTESDVHPSCKVTAMKCFLLELQVISLCSGDASIHDTVENLIILANNSLS
SNGNVTESGCKECEELEEKNIKEFLQSFVHIVQMFINTS

IL-15(C42S) SEQ ID NO:222
NWVNVISDLKKIEDLIQSMHIDATLYTESDVHPSCKVTAMKSFLLELQVISLESGDASIHDTVENLIILANNSLS
SNGNVTESGCKECEELEEKNIKEFLQSFVHIVQMFINTS

IL-15(L45C) SEQ ID NO:223
NWVNVISDLKKIEDLIQSMHIDATLYTESDVHPSCKVTAMKCFLCELQVISLESGDASIHDTVENLIILANNSLS
SNGNVTESGCKECEELEEKNIKEFLQSFVHIVQMFINTS

Figure 35

IL-15Rα(sushi-D96/C97) SEQ ID NO:224
ITCPPPMSVEHADIWVKSYSLYSRERYICNSGFKRKAGTSSLTECVLNKATNVAHWTTPSLKCIRDC IL-15Rα(sushi-D96/P97/C98) SEQ ID NO:225
ITCPPPMSVEHADIWVKSYSLYSRERYICNSGFKRKAGTSSLTECVLNKATNVAHWTTPSLKCIRDPC IL-15Rα(sushi-D96/C97/A98) SEQ ID NO:226
ITCPPPMSVEHADIWVKSYSLYSRERYICNSGFKRKAGTSSLTECVLNKATNVAHWTTPSLKCIRDCA IL-15Rα(sushi-S40C) SEQ ID NO:227
ITCPPPMSVEHADIWVKSYSLYSRERYICNSGFKRKAGTCSLTECVLNKATNVAHWTTPSLKCIR IL-15Rα(sushi-K34C) SEQ ID NO:228
ITCPPPMSVEHADIWVKSYSLYSRERYICNSGFCRKAGTSSLTECVLNKATNVAHWTTPSLKCIR IL-15Rα(sushi-G38C) SEQ ID NO:229
ITCPPPMSVEHADIWVKSYSLYSRERYICNSGFKRKACTSSLTECVLNKATNVAHWTTPSLKCIR IL-15Rα(sushi-L42C) SEQ ID NO:230
ITCPPPMSVEHADIWVKSYSLYSRERYICNSGFKRKAGTSSCTECVLNKATNVAHWTTPSLKCIR IL-15Rα(sushi-A37C) SEQ ID NO:231
ITCPPPMSVEHADIWVKSYSLYSRERYICNSGFKRKCGTSSLTECVLNKATNVAHWTTPSLKCIR dsIL-15/Rα-heteroFc
Example: XENP22013 dsIL-15/Rα-Fc
Example: XENP22357

Bivalent dsIL-15/Rα-Fc
Example: XENP22634

Fc-dsIL-15/Rα
Example: XENP22639

Figure 37A

>XENP022013 human_IL15_E87C_(GGGGS)1-human_IL15Ra(Sushi-D96/C97)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S
SEQ ID NO:232
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK

Chain 2 - human_IL15Ra(Sushi-D96/C97)_(GGGGS)1_Fc(216)_IgG1_C220S/PVA_/S267K/S364K/E357Q SEQ ID NO:233
ITCPPPMSVEHADIWVKSYSLYSRERYICNSGFKRKAGTSSLTECVLNKATNVAHWTTPSLKCIRDC/GGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLTVLHQDWLNGKEYKCK
VSNKALPAPIEKTISKAKGQPREPQVYTLPPSREQMTKNQVKLTCLVKGFYPSDIAVEWESNGQPENNYKTTPPVLDSDGSFFLYSKLTV
DKSRWQQGNVFSCSVMHEALHNHYTQKSLSLSPGK

>XENP022014 human_IL15_E87C_(GGGGS)1-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S
SEQ ID NO:234
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK

Chain 2 - human_IL15Ra(Sushi-D96/P97/C98)_(GGGGS)1_Fc(216)_IgG1_C220S/PVA_/S267K/S364K/E357Q
SEQ ID NO:235
ITCPPPMSVEHADIWVKSYSLYSRERYICNSGFKRKAGTSSLTECVLNKATNVAHWTTPSLKCIRDPC/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

>XENP022015 human_IL15_E87C_(GGGGS)1-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_(GGGGS)1_Fc(216)_IgG1_pI(-)_Isosteric_A_C220S/PVA_/S267K/L368D/K370S
SEQ ID NO:236
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK

Chain 2 - human_IL15Ra(Sushi-D96/C97/A98)_(GGGGS)1_Fc(216)_IgG1_C220S/PVA_/S267K/S364K/E357Q
SEQ ID NO:237
ITCPPPMSVEHADIWVKSYSLYSRERYICNSGFKRKAGTSSLTECVLNKATNVAHWTTPSLKCIRDCA/GGGGS/EPKSSDKTHTCPPCP
APPVAGPSVFLFPPKPKDTLMISRTPEVTCVVVDVKHEDPEVKFNWYVDGVEVHNAKTKPREEQYNSTYRVVSVLTVLHQDWLNGKEYKC
KVSNKALPAPIEKTISKAKGQPREPQVYTLPPSREQMTKNQVKLTCLVKGFYPSDIAVEWESNGQPENNYKTTPPVLDSDGSFFLYSKLT
VDKSRWQQGNVFSCSVMHEALHNHYTQKSLSLSPGK

Figure 37B

>XENP022017 human_IL15_L52C_(GGGGS)1-human_IL15Ra(Sushi-S40C)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_L52C_(GGGGS)1-_Fc(216)_IgG1_pI(-)_Isosteric_A_C220S/PVA_/S267K/L368D/K370S
SEQ ID NO:238
NWVNVISDLKKIEDLIQSMHIDATLYTESDVHPSCKVTAMKCFLLELQVISCESGDASIHDTVENLIILANNSLSSNGNVTESGCKECEE
LEEKNIKEFLQSFVHIVQMFINTS/GGGGS/EPKSSDKTHTCPPCPAPPVAGPSVFLFPPKPKDTLMISRTPEVTCVVVDVKHEDPEVKF
NWYVDGVEVHNAKTKPREEEYNSTYRVVSVLTVLHQDWLNGKEYKCKVSNKALPAPIEKTISKAKGQPREPQVYTLPPSREEMTKNQVSL
TCDVSGFYPSDIAVEWESDGQPENNYKTTPPVLDSDGSFFLYSKLTVDKSRWEQGDVFSCSVMHEALHNHYTQKSLSLSPGK Chain 2 – human_IL15Ra(Sushi-S40C)_(GGGGS)1_Fc(216)_IgG1_C220S/PVA_/S267K/S364K/E357Q SEQ ID
NO:239
ITCPPPMSVEHADIWVKSYSLYSRERYICNSGFKRKAGTCSLTECVLNKATNVAHWTTPSLKCIR/GGGGS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Figure 38A

>XENP022358 – empty-Fc-IL15_E87C-human_IL15Ra(Sushi-D96/P97/C98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) SEQ ID NO:240
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) SEQ ID NO:241
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/P97/C98)_(GGGGS)1_Fc(216)_IgG1_C220S/PVA_/S267K/S364K/E357Q (17039) SEQ ID NO:242
ITCPPPMSVEHADIWVKSYSLYSRERYICNSGFKRKAGTSSLTECVLNKATNVAHWTTPSLKCIRDPC/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP022359 – empty-Fc-IL15_E87C-human_IL15Ra(Sushi-D96/C97/A98)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_E87C_no_tag (17074) SEQ ID NO:243
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

Chain 2 - empty-Fc(216)_IgG1_pI(-)_Isosteric_A_C220S/PVA_/S267K/L368D/K370S (8793) SEQ ID NO:244
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-D96/C97/A98)_(GGGGS)1_Fc(216)_IgG1_C220S/PVA_/S267K/S364K/E357Q (17040) SEQ ID NO:245
ITCPPPMSVEHADIWVKSYSLYSRERYICNSGFKRKAGTSSLTECVLNKATNVAHWTTPSLKCIRDCA/GGGGS/
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 38B

>XENP022361 – empty-Fc-IL15_L52C-human_IL15Ra(Sushi-S40C)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_L52C_no_tag (17072) SEQ ID NO:246
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

Chain 2 - empty-Fc(216)_IgG1_pI(-)_Isosteric_A_C220S/PVA_/S267K/L368D/K370S (8793) SEQ ID NO:247
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 3 - human_IL15Ra(Sushi-S40C)_(GGGGS)1_Fc(216)_IgG1_C220S/PVA_/S267K/S364K/E357Q (17044)
SEQ ID NO:248
ITCPPPMSVEHADIWVKSYSLYSRERYICNSGFKRKAGTCSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP022684 empty-Fc-IL15_E87C-human_IL15Ra(Sushi-D96/C97/A98)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL15_E87C SEQ ID NO:249
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain 2 - IL15Ra(Sushi-D96/C97/A98)_Fc(216)_IgG1_pI(-)_Isosteric_A_C220S/PVA_/S267K/L368D/K370S
SEQ ID NO:250
ITCPPPMSVEHADIWVKSYSLYSRERYICNSGFKRKAGTSSLTECVLNKATNVAHWTTPSLKCIRDCA/EPKSSDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNGKEYKCKVSNKA
LPAPIEKTISKAKGQPREPQVYTLPPSREQMTKNQVKLTCLVKGFYPSDIAVEWESNGQPENNYKTTPPVLDSDGSFFLYSKLTVDKSRW
QQGNVFSCSVMHEALHNHYTQKSLSLSPGK

Figure 39

>XENP022634 – human_IL15(E87C)-human_IL15Ra(Sushi-D96/C97)_Fc(216)_IgG1_C220S/PVA_/S267K

Chain 1 - human_IL15Ra(Sushi-D96/C97)-Fc(216)_IgG1_C220S/PVA_/S267K (17581) SEQ ID NO:251
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK

Chain 2 - human_IL15_E87C_no_tag (17074) SEQ ID NO:252
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022635 – human_IL15(E87C)-human_IL15Ra(Sushi-D96/C97/A98)_Fc(216)_IgG1_C220S/PVA_/S267K

Chain 1 - human_IL15Ra(Sushi-D96/C97/A98)-Fc(216)_IgG1_C220S/PVA_/S267K (17582) SEQ ID NO:253
ITCPPPMSVEHADIWVKSYSLYSRERYICNSGFKRKAGTSSLTECVLNKATNVAHWTTPSLKCIRDCA/EPKSSD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREEMTKNQVSLTCLVKGF
YPSDIAVEWESNGQPENNYKTTPPVLDSDGSFFLYSKLTVDKSRWQQGNVFSCSVMHEALHNHYTQKSLSLSPGK

Chain 2 - human_IL15_E87C_no_tag (17074) SEQ ID NO:254
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS

>XENP022636 – human_IL15(L52C)-human_IL15Ra(Sushi-S40C)_Fc(216)_IgG1_C220S/PVA_/S267K

Chain 1 - human_IL15Ra(Sushi-S40C)-Fc(216)_IgG1_C220S/PVA_/S267K (17583) SEQ ID NO:255
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Chain 2 - human_IL15_L52C_no_tag (17072) SEQ ID NO:256
NWVNVISDLKKIEDLIQSMHIDATLYTESDVHPSCKVTAMKCFLLELQVISCESGDASIHDTVENLIILANNSLS
SNGNVTESGCKECEELEEKNIKEFLQSFVHIVQMFINTS

Figure 40

>XENP022639 – empty-Fc(216)_IgG1_pI(-
)_Isosteric_A_C220S/PVA_/S267K/L368D/K370S_(GGGGS)2_IL15Ra(Sushi-
D96/C97)_IL15(E87C)_IgG1_ISO(+RR)_C220S/PVA_/S267K/S364K/E357Q Chain 1 - empty-Fc(216)_IgG1_pI(-)_Isosteric_A_C220S/PVA_/S267K/L368D/K370S_(GGGGS)2_IL15Ra(Sushi-
D96/C97) (17605) SEQ ID NO:257
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK/GGGGSGGGGS/ITCPPPMSVEHADIWVKSYSLYSRERYICNSGFKRKAGTSSLTECVLNKATNVAHWT
TPSLKCIRDC Chain 2 - empty-Fc(216)_IgG1_ISO(+RR)_C220S/PVA_/S267K/S364K/E357Q (8927) SEQ ID NO:258
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK Chain 3 - human_IL15_E87C_no_tag (17074) SEQ ID NO:259
NWVNVISDLKKIEDLIQSMHIDATLYTESDVHPSCKVTAMKCFLLELQVISLESGDASIHDTVENLIILANNSLS
SNGNVTESGCKCCEELEEKNIKEFLQSFVHIVQMFINTS >XENP022640 empty-Fc(216)_IgG1_pI(-
)_Isosteric_A_C220S/PVA_/S267K/L368D/K370S_IgG1_ISO(+RR)_C220S/PVA_/S267K/S364K/E357Q_(GGGGS
)2_IL15Ra(Sushi-D96/C97)_IL15(E87C)

Chain 1 – IL15 SEQ ID NO:260
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain 2 – empty_Fc(216)_IgG1_pI(-)_Isosteric_A_C220S/PVA_/S267K/L368D/K370S SEQ ID NO:261
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Figure 44A

N1D (SEQ ID NO:262)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

N4D (SEQ ID NO:263)
NWVDVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D8N (SEQ ID NO:264)
NWVNVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D30N (SEQ ID NO:265)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVQMFINTS

D61N (SEQ ID NO:266)
NWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

E64Q (SEQ ID NO:267)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N65D (SEQ ID NO:268)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

Q108E (SEQ ID NO:269)
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N1D/D61N (SEQ ID NO:270)
DWVNVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N1D/E64Q (SEQ ID NO:271)
DWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

N4D/D61N (SEQ ID NO:272)
NWVDVISDLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

N4D/E64Q (SEQ ID NO:273)
NWVDVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D8N/D61N (SEQ ID NO:274)
NWVNVISNLKKIEDLIQSMHIDATLYTESDVHPSCKVTAMKCFLLELQVISLESGDASIHNTVENLIILANNSLSSNGNVTESGCKECEE
LEEKNIKEFLQSFVHIVQMFINTS

Figure 44B

D8N/E64Q (SEQ ID NO:275)
NWVNVISNLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVQMFINTS

D61N/E64Q (SEQ ID NO:276)
NWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVQMFINTS

E64Q/Q108E (SEQ ID NO:277)
NWVNVISDLKKIEDLIQSMHIDATLYTESDVHPSCKVTAMKCFLLELQVISLESGDASIHDTVQNLIILANNSLSSNGNVTESGCKECEE
LEEKNIKEFLQSFVHIVEMFINTS

N1D/N4D/D8N (SEQ ID NO:278)
DWVDVISNLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

D61N/E64Q/N65D (SEQ ID NO:279)
NWVNVISDLKKIEDLIQSMHIDATLYTESDVHPSCKVTAMKCFLLELQVISLESGDASIHNTVQDLIILANNSLSSNGNVTESGCKECEE
LEEKNIKEFLQSFVHIVQMFINTS

N1D/D61N/E64Q/Q108E (SEQ ID NO:280)
DWVNVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N4D/D61N/E64Q/Q108E (SEQ ID NO:281)
NWVDVISDLKKIEDLIQSMHIDATLYTESDVHPSCKVTAMKCFLLELQVISLESGDASIHNTVQNLIILANNSLSSNGNVTESGCKECEE
LEEKNIKEFLQSFVHIVEMFINTS

N1D/N65D (SEQ ID NO:282)
DWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

N1D/Q108E (SEQ ID NO:283)
DWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVEMFINTS

N4D/N65D (SEQ ID NO:284)
NWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/N65D (SEQ ID NO:285)
NWVNVISDLKKIEDLIQSMHIDATLYTESNVHPSCKVTAMKCFLLELQVISLESGDASIHDTVEDLIILANNSLSSNGNVTESGCKECEE
LEEKNIKEFLQSFVHIVQMFINTS

D30N/Q108E (SEQ ID NO:286)
NWVNVISDLKKIEDLIQSMHIDATLYTESNVHPSCKVTAMKCFLLELQVISLESGDASIHDTVENLIILANNSLSSNGNVTESGCKECEE
LEEKNIKEFLQSFVHIVEMFINTS

N65D/Q108E (SEQ ID NO:287)
NWVNVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVEMFINTS

Figure 44C

E64Q/N65D (SEQ ID NO:288)
NWVNVISDLKKIEDLIQSMHIDATLYTESDVHPSCKVTAMKCFLLELQVISLESGDASIHDTVQDLIILANNSLSSNGNVTESGCKECEE
LEEKNIKEFLQSFVHIVQMFINTS

N1D/N4D/N65D (SEQ ID NO:289)
DWVDVISDLKKIEDLIQSMHIDATLYTESDVHPSCKVTAMKCFLLELQVISLESGDASIHDTVEDLIILANNSLSSNGNVTESGCKECEE
LEEKNIKEFLQSFVHIVQMFINTS

D30N/E64Q/N65D (SEQ ID NO:290)
NWVNVISDLKKIEDLIQSMHIDATLYTESNVHPSCKVTAMKCFLLELQVISLESGDASIHDTVQDLIILANNSLSSNGNVTESGCKECEE
LEEKNIKEFLQSFVHIVQMFINTS

N4D/D61N/N65D (SEQ ID NO:291)
NWVDVISDLKKIEDLIQSMHIDATLYTESDVHPSCKVTAMKCFLLELQVISLESGDASIHNTVEDLIILANNSLSSNGNVTESGCKECEE
LEEKNIKEFLQSFVHIVQMFINTS

Figure 45A

>XENP022821 - human_IL15_N65D_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N65D_(GGGGS)₁ (17692) SEQ ID NO:292
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
SEQ ID NO:293
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP022822 - human_IL15_Q108E_(GGGGS)₁-human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_Q108E_(GGGGS)₁ (17693) SEQ ID NO:294
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Rα(Sushi)_(GGGGS)₁_Fc(216)_IgG1_pI(-
)_Isosteric_A_C220S/PVA_/S267K/L368D/K370S-Fc(216)_IgG1_C220S/PVA_/S267K/S364K/E357Q (15908)
SEQ ID NO:295
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK >XENP023554 - human_IL15_N1D/N65D_(GGGGS)1-human_IL15Ra(Sushi)_(GGGGS)1_Fc(216)_IgG1_pI(-
)_Isosteric_A_C220S/PVA_/S267K/L368D/K370S-Fc(216)_IgG1_C220S/PVA_/S267K/S364K/E357Q Chain 1 - human_IL15_N1D/N65D_(GGGGS)1_Fc(216)_IgG1_pI(-
)_Isosteric_A_C220S/PVA_/S267K/L368D/K370S (18783) SEQ ID NO:296
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK Chain 2 - human_IL15Ra(Sushi)_(GGGGS)1_Fc(216)_IgG1_C220S/PVA_/S267K/S364K/E357Q (15908) SEQ ID
NO:297
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

Figure 45B

>XENP023557 - human_IL15_N4D/N65D_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N4D/N65D_(GGGGS)1_Fc(216)_IgG1_pI(-)_Isosteric_A_C220S/PVA_/S267K/L368D/K370S (18786) SEQ ID NO:298
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Ra(Sushi)_(GGGGS)1_Fc(216)_IgG1_C220S/PVA_/S267K/S364K/E357Q (15908) SEQ ID NO:299
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

>XENP023561 human_IL15_N65D/Q108E_(GGGGS)1-human_IL15Ra(Sushi)_(GGGGS)1_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15_N65D/Q108E_(GGGGS)1_Fc(216)_IgG1_pI(-)_Isosteric_A_C220S/PVA_/S267K/L368D/K370S SEQ ID NO:300
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVEMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 - human_IL15Ra(Sushi)_(GGGGS)1_Fc(216)_IgG1_C220S/PVA_/S267K/S364K/E357Q SEQ ID NO:301
ITCPPPMSVEHADIWVKSYSLYSRERYICNSGFKRKAGTSSLTECVLNKATNVAHWTTPSLKCIR/GGGGS/EPKSSDKTHTCP
PCPAPPVAGPSVFLFPPKPKDTLMISRTPEVTCVVVDVKHEDPEVKFNWYVDGVEVHNAKTKPREEQYNSTYRVV
SVLTVLHQDWLNGKEYKCKVSNKALPAPIEKTISKAKGQPREPQVYTLPPSREQMTKNQVKLTCLVKGFYPSDIA
VEWESNGQPENNYKTTPPVLDSDGSFFLYSKLTVDKSRWQQGNVFSCSVMHEALHNHYTQKSLSLSPGK

>XENP024018 human_IL15(N65D)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15(N65D)_Fc(216)_IgG1_pI(-)_Isosteric_A_C220S/PVA_/S267K/L368D/K370S SEQ ID NO:302
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q SEQ ID NO:303
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 45C

**>XENP024019 - human_IL15(Q108E)-human_IL15Ra(Sushi)_Fc(216)_IgG1_pI(-
)_Isosteric_A_C220S/PVA_/S267K/L368D/K370S-Fc(216)_IgG1_C220S/PVA_/S267K/S364K/E357Q**

**Chain 1 - human_IL15(Q108E)-human_IL15Ra(Sushi)_Fc(216)_IgG1_pI(-
)_Isosteric_A_C220S/PVA_/S267K/L368D/K370S (19242)** SEQ ID NO:304
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 - human_IL15Ra(Sushi)_Fc(216)_IgG1_C220S/PVA_/S267K/S364K/E357Q (16481) SEQ ID NO:305
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

**>XENP024045 human_IL15_D30N/E64Q/N65D_(GGGGS)1-
human_IL15Rα(Sushi)_(GGGGS)1_Fc(216)_IgG1_pI(-)_Isosteric_A_C220S/PVA_/S267K/L368D/K370S-
Fc(216)_IgG1_C220S/PVA_/S267K/S364K/E357Q**

**Chain 1 – human_IL15_D30N/E64Q/N65D_(GGGGS)1_Fc(216)_IgG1_pI(-
)_Isosteric_A_C220S/PVA_/S267K/L368D/K370S** SEQ ID NO:306
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS/GGGGS/EPKSSDKTHTCPPCPAPPVAGPSVFLFPP
KPKDTLMISRTPEVTCVVVDVKHEDPEVKFNWYVDGVEVHNAKTKPREEEYNSTYRVVSVLTVLHQDWLNGKEYK
CKVSNKALPAPIEKTISKAKGQPREPQVYTLPPSREEMTKNQVSLTCDVSGFYPSDIAVEWESDGQPENNYKTTP
PVLDSDGSFFLYSKLTVDKSRWEQGDVFSCSVMHEALHNHYTQKSLSLSPGK

Chain 2 – human_IL15Rα(Sushi)_(GGGGS)1_ Fc(216)_IgG1_C220S/PVA_/S267K/S364K/E357Q SEQ ID
NO:307
ITCPPPMSVEHADIWVKSYSLYSRERYICNSGFKRKAGTSSLTECVLNKATNVAHWTTPSLKCIR/GGGGS/EPK
SSDKTHTCPPCPAPPVAGPSVFLFPPKPKDTLMISRTPEVTCVVVDVKHEDPEVKFNWYVDGVEVHNAKTKPREE
QYNSTYRVVSVLTVLHQDWLNGKEYKCKVSNKALPAPIEKTISKAKGQPREPQVYTLPPSREQMTKNQVKLTCLV
KGFYPSDIAVEWESNGQPENNYKTTPPVLDSDGSFFLYSKLTVDKSRWQQGNVFSCSVMHEALHNHYTQKSLSLS
PGK

**>XENP024051 human_IL15_N1D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q**

**Chain 1 – human_IL15_N1D/N65D-human_Fc(216)_IgG1_pI(-
)_Isosteric_A_C220S/PVA_/S267K/L368D/K370S** SEQ ID NO:308
DWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK

Chain 2 – human_IL15Rα(Sushi)_ Fc(216)_IgG1_C220S/PVA_/S267K/S364K/E357Q SEQ ID NO:309
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 45D

>XENP024052 human_IL15_N4D/N65D-human_IL15Rα(Sushi)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – human_IL15_N4D/N65D-human_ Fc(216)_IgG1_pI(-
)_Isosteric_A_C220S/PVA_/S267K/L368D/K370S SEQ ID NO:310
NWVDVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS/EPKSSDKTHTCPPCPAPPVAGPSVFLFPPKPKDTL
MISRTPEVTCVVVDVKHEDPEVKFNWYVDGVEVHNAKTKPREEEYNSTYRVVSVLTVLHQDWLNGKEYKCKVSNK
ALPAPIEKTISKAKGQPREPQVYTLPPSREEMTKNQVSLTCDVSGFYPSDIAVEWESDGQPENNYKTTPPVLDSD
GSFFLYSKLTVDKSRWEQGDVFSCSVMHEALHNHYTQKSLSLSPGK Chain 2 – human_IL15Rα(Sushi)_Fc(216)_IgG1_C220S/PVA_/S267K/S364K/E357Q SEQ ID NO:311
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 46A

>XENP024015 human_IL15Ra(sushi)_(GGGGS)5-human_IL15(Q108E;single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15(Q108E;single-chain)_Fc(216)_IgG1_pI(-)_Isosteric_A_C220S/PVA_/S267K/L368D/K370S SEQ ID NO:312

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESDVHPSCKVTAMKCFLLELQVISLESGDAS
IHDTVENLIILANNSLSSNGNVTESGCKECEELEEKNIKEFLQSFVHIVEMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – empty_Fc(216)_IgG1_C220S/PVA_/S267K/S364K/E357Q SEQ ID NO:313

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024050 human_IL15Ra(sushi)_(GGGGS)5-human_IL15_N4D/N65D_(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)5-human_IL15_N4D/N65D_(single-chain)_Fc(216)_IgG1_pI(-)_Isosteric_A_C220S/PVA_/S267K/L368D/K370S SEQ ID NO:314

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 – empty_ Fc(216)_IgG1_C220S/PVA_/S267K/S364K/E357Q SEQ ID NO:315

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024475 human_IL15Ra(sushi)_(GGGGS)6-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;Q108E)_Fc(216)_IgG1_pI(-)_Isosteric_A_C220S/PVA_/S267K/L368D/K370S SEQ ID NO:316

ITCPPPMSVEHADIWVKSYSLYSRERYICNSGFKRKAGTSSLTECVLNKATNVAHWTTPSLKCIR/GGGGSGGGG
SGGGGSGGGGSGGGGSGGGGS/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_ Fc(216)_IgG1_C220S/PVA_/S267K/S364K/E357Q SEQ ID NO:317

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 46B

>XENP024476 human_IL15Ra(sushi)_(GGGGS)6-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain;N4D/N65D)_Fc(216)_IgG1_pI(-)_Isosteric_A_C220S/PVA_/S267K/L368D/K370S SEQ ID NO:318
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGS</u>/NWVDVISDLKKIEDLIQSMHIDATLYTESDVHPSCKVTAMKCFLLELQVISLE
SGDASIHDTVEDLIILANNSLSSNGNVTESGCKECEELEEKNIKEFLQSFVHIVQMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK

Chain 2 – empty_ Fc(216)_IgG1_C220S/PVA_/S267K/S364K/E357Q SEQ ID NO:319
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024478 human_IL15Ra(sushi)_(GGGGS)7-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;Q108E)_Fc(216)_IgG1_pI(-)_Isosteric_A_C220S/PVA_/S267K/L368D/K370S SEQ ID NO:320
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGSGGGGS</u>/NWVNVISDLKKIEDLIQSMHIDATLYTESDVHPSCKVTAMKCFLLELQ
VISLESGDASIHDTVENLIILANNSLSSNGNVTESGCKECEELEEKNIKEFLQSFVHIVEMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 – empty_ Fc(216)_IgG1_C220S/PVA_/S267K/S364K/E357Q SEQ ID NO:321
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

>XENP024479 human_IL15Ra(sushi)_(GGGGS)7-human_IL15(single-chain;N4D/N65D)-empty-Fc_Fc(216)_IgG1_pI(-)_Isosteric_A_C220S/PVA_/S267K/L368D/K370S-Fc(216)_IgG1_C220S/PVA_/S267K/S364K/E357Q

Chain 1 - human_IL15Ra(sushi)_(GGGGS)7-human_IL15(single-chain;N4D/N65D)_Fc(216)_IgG1_pI(-)_Isosteric_A_C220S/PVA_/S267K/L368D/K370S SEQ ID NO:322
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGSGGGGSGGGGS</u>/NWVDVISDLKKIEDLIQSMHIDATLYTESDVHPSCKVTAMKCFLLELQ
VISLESGDASIHDTVEDLIILANNSLSSNGNVTESGCKECEELEEKNIKEFLQSFVHIVQMFINTS/EPKSSDKT
HTCPPCPAPPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLSLSPGK

Chain 2 - empty-Fc_Fc(216)_IgG1_C220S/PVA_/S267K/S364K/E357Q SEQ ID NO:323
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 46C

>XENP024481 human_IL15Ra(sushi)_(30AA_linker_variant)-human_IL15(single-chain;Q108E)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(30AA_linker_variant)-human_IL15(single-chain;Q108E)_Fc(216)_IgG1_pI(-)_Isosteric_A_C220S/PVA_/S267K/L368D/K370S SEQ ID NO:324
ITCPPPMSVEHADIWVKSYSLYSRERYICNSGFKRKAGTSSLTECVLNKATNVAHWTTPSLKCIR/DPALVHQRP
APPGGGGSGGGGSGGGGSGGG/NWVNVISDLKKIEDLIQSMHIDATLYTESDVHPSCKVTAMKCFLLELQVISLE
SGDASIHDTVENLIILANNSLSSNGNVTESGCKECEELEEKNIKEFLQSFVHIVEMFINTS/EPKSSDKTHTCPP
CPAPPVAGPSVFLFPPKPKDTLMISRTPEVTCVVVDVKHEDPEVKFNWYVDGVEVHNAKTKPREEEYNSTYRVVS
VLTVLHQDWLNGKEYKCKVSNKALPAPIEKTISKAKGQPREPQVYTLPPSREEMTKNQVSLTCDVSGFYPSDIAV
EWESDGQPENNYKTTPPVLDSDGSFFLYSKLTVDKSRWEQGDVFSCSVMHEALHNHYTQKSLSLSPGK Chain 2 – empty_ Fc(216)_IgG1_C220S/PVA_/S267K/S364K/E357Q SEQ ID NO:325
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 47A

**>XENP024349 IL15_Q108E_(non-covalent)-human_IL15Rα(Sushi)_empty-Fc_Fc(216)_IgG1_pI(-
)_Isosteric_A_C220S/PVA_/S267K/L368D/K370S-Fc(216)_IgG1_C220S/PVA_/S267K/S364K/E357Q**

Chain 1 – human_IL15Rα(Sushi)_ Isosteric_A_C220S/PVA_/S267K/L368D/K370S SEQ ID NO:326
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 – empty- Fc(216)_IgG1_C220S/PVA_/S267K/S364K/E357Q SEQ ID NO:327
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Chain 3 – IL15_Q108E_(non-covalent) SEQ ID NO:328
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

**>XENP024890 IL15_N4D/N65D_(non-covalent)-human_IL15Ra(Sushi)-empty-Fc_IgG1_Fc(216)_IgG1_pI(-
)_Isosteric_A_C220S/PVA_/S267K/L368D/K370S-IgG1_PVA_/S267K/S364K/E357Q**

Chain 1 – IL-15_N4D/N65D SEQ ID NO:329
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 2 - human_IL15Ra(Sushi)_Fc(216)_IgG1_pI(-)_Isosteric_A_C220S/PVA_/S267K/L368D/K370S SEQ ID
NO:330
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 – empty_Fc(216)_ IgG1_PVA_/S267K/S364K/E357Q SEQ ID NO:331
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 47B

**>XENP25138 IL15_D30N/E64Q/N65D_(non-covalent)-empty-Fc_Fc(216)_IgG1_pI(-
)_Isosteric_A_C220S/PVA_/S267K/L368D/K370S-IgG1_PVA_/S267K/S364K/E357Q**

Chain 1 - IL15_D30N/E64Q/N65D SEQ ID NO:332
NWVNVISDLKKIEDLIQSMHIDATLYTESNVHPSCKVTAMKCFLLELQVISLESGDASIHDTVQDLIILANNSLS
SNGNVTESGCKECEELEEKNIKEFLQSFVHIVQMFINTS

Chain 2 - human_IL15Ra(Sushi)_Fc(216)_IgG1_pI(-)_Isosteric_A_C220S/PVA_/S267K/L368D/K370S SEQ ID NO:333
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEEYNSTY
RVVSVLTVLHQDWLNGKEYKCKVSNKALPAPIEKTISKAKGQPREPQVYTLPPSREEMTKNQVSLTCDVSGFYPS
DIAVEWESDGQPENNYKTTPPVLDSDGSFFLYSKLTVDKSRWEQGDVFSCSVMHEALHNHYTQKSLSLSPGK

Chain 3 - empty_Fc(216)_IgG1_PVA_/S267K/S364K/E357Q SEQ ID NO:334
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK

Figure 48

>XENP022801 - human_IL15_N65D(non-covalent)-human_IL15Rα(Sushi)

Chain 1 - human_IL15_N65D(non-covalent) (17672) SEQ ID NO:335
NWVNVISDLKKIEDLIQSMHIDATLYTESDVHPSCKVTAMKCFLLELQVISLESGDASIHDTVEDLIILANNSLS
SNGNVTESGCKECEELEEKNIKEFLQSFVHIVQMFINTS

Chain 2 - human_IL15Rα(Sushi) (17033) SEQ ID NO:336
ITCPPPMSVEHADIWVKSYSLYSRERYICNSGFKRKAGTSSLTECVLNKATNVAHWTTPSLKCIR

>XENP022802 - human_IL15_Q108E(non-covalent)-human_IL15Rα(Sushi)

Chain 1 - human_IL15_Q108E(non-covalent) (17673) SEQ ID NO:337
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Chain 2 - human_IL15Rα(Sushi) (17033) SEQ ID NO:338
ITCPPPMSVEHADIWVKSYSLYSRERYICNSGFKRKAGTSSLTECVLNKATNVAHWTTPSLKCIR

Figure 49

>XENP024342 human_IL15(non-covalent; Q108E)-human_IL15Rα(Sushi)_Fc(216)_IgG1_C220S/PVA_/S267K

Chain 1 – human_IL15Rα(Sushi) _Fc(216)_IgG1_C220S/PVA_/S267K SEQ ID NO:339
ITCPPPMSVEHADIWVKSYSLYSRERYICNSGFKRKAGTSSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK Chain 2 –human_IL15(non-covalent; Q108E) SEQ ID NO:340
NWVNVISDLKKIEDLIQSMHIDATLYTESDVHPSCKVTAMKCFLLELQVISLESGDASIHDTVENLIILANNSLS
SNGNVTESGCKECEELEEKNIKEFLQSFVHIVEMFINTS

Figure 50

>XENP023472 empty-Fc-IL15_N65D/E87C-human_IL15Ra(Sushi-D96/C97)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S SEQ ID NO:341
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/E87C SEQ ID NO:342
NWVNVISDLKKIEDLIQSMHIDATLYTESDVHPSCKVTAMKCFLLELQVISLESGDASIHDTVEDLIILANNSLS
SNGNVTESGCKCCEELEEKNIKEFLQSFVHIVQMFINTS

Chain 3 - IL15Ra(Sushi-D96/C97)_Fc(216)_IgG1_C220S/PVA_/S267K/S364K/E357Q SEQ ID NO:343
ITCPPPMSVEHADIWVKSYSLYSRERYICNSGFKRKAGTSSLTECVLNKATNVAHWTTPSLKCIRDC/EPKSSDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK

>XENP023473 empty-Fc-IL15_N65D/L52C-human_IL15Ra(Sushi-S40C)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – empty_ Fc(216)_IgG1_pI(-)_Isosteric_A_C220S/PVA_/S267K/L368D/K370S SEQ ID NO:344
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK

Chain 2 - IL15_N65D/L52C SEQ ID NO:345
NWVNVISDLKKIEDLIQSMHIDATLYTESDVHPSCKVTAMKCFLLELQVISCESGDASIHDTVEDLIILANNSLS
SNGNVTESGCKECEELEEKNIKEFLQSFVHIVQMFINTS

Chain 3 - IL15Ra(Sushi-S40C)_Fc(216)_IgG1_C220S/PVA_/S267K/S364K/E357Q SEQ ID NO:346
ITCPPPMSVEHADIWVKSYSLYSRERYICNSGFKRKAGTCSLTECVLNKATNVAHWTTPSLKCIR/EPKSSDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Figure 52

| XENP | Variant | EC50 pM (NK cells) | Fold reduced (NK cells) | EC50 pM (CD8 T cells) | Fold reduced (CD8 T cells) |
|---|---|---|---|---|---|
| 20818 | WT | 200.6 | | 637.1 | |
| 21478 | single-chain | 848.5 | 4.2 | 4982.0 | 7.8 |
| 22815 | N1D | 281.3 | 1.4 | 1051.0 | 1.6 |
| 22816 | N4D | 321.9 | 1.6 | 1190.0 | 1.9 |
| 22817 | D8N | very weak | very weak | very weak | very weak |
| 22818 | D30N | 376.3 | 1.9 | 1366.0 | 2.1 |
| 22819 | D61N | 5934.0 | 29.6 | 161937.0 | >100 |
| 22820 | E64Q | 877.0 | 4.4 | 2858.0 | 4.5 |
| 22821 | N65D | 2883.0 | 14.4 | 6928.0 | 10.9 |
| 22822 | Q108E | 9777.0 | 48.7 | very weak | >100 |
| 22823 | N1D/D61N | 918.0 | 4.6 | 4225.0 | 6.6 |
| 22824 | N1D/E64Q | 1091.0 | 5.4 | 4228.0 | 6.6 |
| 22825 | N4D/D61N | 309.0 | 1.5 | 1070.0 | 1.7 |
| 22826 | N4D/E64Q | very weak | very weak | very weak | very weak |
| 22827 | D8N/D61N | ND | ND | ND | ND |
| 22828 | D8N/E64Q | 597.7 | 3.0 | 1658.0 | 2.6 |
| 22829 | D61N/E64Q | 458.2 | 2.3 | 2115.0 | 3.3 |
| 22830 | E64Q/Q108E | 436.6 | 2.2 | 1815.0 | 2.8 |
| 22831 | N1D/N4D/D8N | very weak | very weak | very weak | very weak |
| 22832 | D61N/E64Q/N65D | ND | ND | ND | ND |
| 22833 | N1D/D61N/E64Q/Q108E | ND | ND | ND | ND |
| 22834 | N4D/D61N/E64Q/Q108E | very weak | very weak | very weak | very weak |

Figure 56D

| XENP | EC50 nM (NK cells) | Fold reduced (NK cells) | EC50 nM (CD8 T cells) | Fold reduced (CD8 T cells) | EC50 nM (CD4 T cells) | Fold reduced (CD4 T cells) |
|---|---|---|---|---|---|---|
| 20818 | 0.3223 | 1.0 | 2.701 | 1.0 | 16.467 | 1.0 |
| 21478 | 1.116 | 3.5 | 11.728 | 4.3 | 28.349 | 1.7 |
| 22818 | 0.4205 | 1.3 | 2.829 | 1.0 | 40.676 | 2.5 |
| 22819 | 1.016 | 3.2 | 8.254 | 3.1 | 18.101 | 1.1 |
| 22820 | 0.562 | 1.7 | 3.918 | 1.5 | 10.362 | 0.6 |
| 22821 | 3.14 | 9.7 | 18.706 | 6.9 | 112.823 | 6.9 |
| 22822 | 68.866 | 213.7 | 6439.69 | 2384.2 | 48.738 | 3.0 |
| 22825 | 1.769 | 5.5 | 12.09 | 4.5 | 60.081 | 3.6 |
| 22826 | 1.448 | 4.5 | 9.678 | 3.6 | 22.41 | 1.4 |
| 22829 | 4.839 | 15.0 | 29.638 | 11.0 | 337.571 | 20.5 |
| 22834 | 331.293 | 1027.9 | 4107.897 | 1520.9 | ND | ND |
| IL-15 | 0.05322 | 0.2 | 0.3452 | 0.1 | ND | ND | scIL-15/Rα x scFv
Example: XENP21480 scFv x ncIL-15/Rα scFv x dsIL-15/Rα scIL-15/Rα x Fab
Example: XENP22022

Fab x ncIL-15/Rα
Example: XENP22112

Fab x dsIL-15/Rα
Example: XENP22641 mAb-scIL-15/Rα

Example: XENP22642
mAb-ncIL-15/Rα
Example: XENP22642 mAb-dsIL-15/Rα
Example: XENP22644 central-IL-15/Rα central-scIL-15/Rα

Figure 66

XENP021480 human_IL15Ra(sushi)_(GGGGS)6-human_IL15(single-chain)-
1G6_L1.194_H1.279_scFv(GKPGS)4_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)6-human_IL15(single-chain)_IgG1_pI(-
)_Isosteric_A_C220S/PVA_/S267K/L368D/K370S SEQ ID NO:347

ITCPPPMSVEHADIWVKSYSLYSRERYICNSGFKRKAGTSSLTECVLNKATNVAHWTTPSLKCIR/GGGGSGGGGSGGGGSGGGGSGGGG
SGGGGS/NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK

Chain 2 - 1G6_L1.194_H1.279_scFv(GKPGS)4_IgG1_C220S/PVA_/S267K/S364K/E357Q SEQ ID NO:348

EIVLTQSPATLSASPGERVTLTCRASQSVGNDVAWYQQKPGQAPRLLINYASHRYTGVPDRFTGSGYGTEFTLTISSVQSEDFGVYYC**QQ
DFSSPRTFGGGTKVEIK/GKPGSGKPGSGKPGSGKPGS/EVQLVESGGGLVKPGGSLRLSCVASGFTFSNYWMNWVRQAPGKGLEWVAEI
RLYSNNYATHYAESVKGRFTISRDDSKSTLYLQMNNLKTEDTGVYYCTRYYGNYGGYFDV**WGRGTLVTVSS/EPKSSDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDWLNGKEYKCKVS
NKALPAPIEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Figure 67

1G6_L1.194_H1.279_scFv(GKPGS)4-human_IL15Ra(sushi)_(GGGGS)6-human_IL15(non-covalent)_Fc(216)_IgG1_pI(-)_Isosteric_A_C220S/PVA_/S267K/L368D/K370S-Fc(216)_IgG1_C220S/PVA_/S267K/S364K/E357Q Chain 1 – 1G6_L1.194_H1.279_scFv(GKPGS)4_ Fc(216)_IgG1_pI(-)_Isosteric_A_C220S/PVA_/S267K/L368D/K370S SEQ ID NO:349

EIVLTQSPATLSASPGERVTLTCRASQSVGNDVAWYQQKPGQAPRLLINYASHRYTGVPDRFTGSGYGTEFTLTISSVQSEDFGVYYCQQ
DFSSPRTFGGGTKVEIK/GKPGSGKPGSGKPGSGKPGS/EVQLVESGGGLVKPGGSLRLSCVASGFTFSNYWMNWVRQAPGKGLEWVA**EI
RLYSNNYATHYAESVKGRFTISRDDSKSTLYLQMNNLKTEDTGVYYCTRYYGNYGGYFDV**WGRGTLVTVSS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVLHQDWLNGKEYKCKVS
NKALPAPIEKTISKAKGQPREPQVYTLPPSREEMTKNQVSLTCDVSGFYPSDIAVEWESDGQPENNYKTTPPVLDSDGSFFLYSKLTVDK
SRWEQGDVFSCSVMHEALHNHYTQKSLSLSPGK

Chain2-human_IL15Ra(sushi)_(GGGGS)6_ Fc(216)_IgG1_C220S/PVA_/S267K/S364K/E357Q SEQ ID NO:350

ITCPPPMSVEHADIWVKSYSLYSRERYICNSGFKRKAGTSSLTECVLNKATNVAHWTTPSLKCIR/GGGGSGGGGSGGGGSGGGGSGGGG
SGGGGS/EPKSSDKTHTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYPSDIAVEWESNGQPEN
NYKTTPPVLDSDGSFFLYSKLTVDKSRWQQGNVFSCSVMHEALHNHYTQKSLSLSPGK

Chain3–IL-15 SEQ ID NO:351

NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

Figure 68

1G6_L1.194_H1.279_scFv(GKPGS)4-human_IL15Ra(sushi-D96/C97/A98)-human_IL15(E87C)_Fc(216)_IgG1_pI(-)_Isosteric_A_C220S/PVA_/S267K/L368D/K370S-Fc(216)_IgG1_C220S/PVA_/S267K/S364K/E357Q Chain 1 – 1G6_L1.194_H1.279_scFv(GKPGS)4_ Fc(216)_IgG1_pI(-)_Isosteric_A_C220S/PVA_/S267K/L368D/K370S SEQ ID NO:352

EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK/GKPGSGKPGSGKPGSGKPGS/EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS/EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

Chain2-human_IL15Ra(sushi-D96/C97/A98)_ Fc(216)_IgG1_C220S/PVA_/S267K/S364K/E357Q SEQ ID NO:353

ITCPPPMSVEHADIWVKSYSLYSRERYICNSGFKRKAGTSSLTECVLNKATNVAHWTTPSLKCIRDCA/EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

Chain3–IL-15(E87C) SEQ ID NO:354

NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

Figure 69A

XENP022022human_IL15Ra(sushi)_(GGGGS)6-human_IL15(single-chain)-1G6_H1.278_L1.188_[PD-1]_Fab_IgG1_pI(-)_Isosteric_A_/PVA_/S267K/L368D/K370S-Fc(216)_IgG1_C220S/PVA_/S267K/S364K/E357Q

Chain 1 - human_IL15Ra(sushi)_(GGGGS)6-human_IL15(single-chain)_ IgG1_pI(-)_Isosteric_A_/PVA_/S267K/L368D/K370S SEQ ID NO:355
ITCPPPMSVEHADIWVKSYSLYSRERYICNSGFKRKAGTSSLTECVLNKATNVAHWTTPSLKCIR/GGGGSGGGGSGGGGSGGGGSGGGG
SGGGGS/NWVNVISDLKKIEDLIQSMHIDATLYTESDVHPSCKVTAMKCFLLELQVISLESGDASIHDTVENLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK Chain2-1G6_H1.278 [PD-1]_IgG1_C220S/PVA_/S267K/S364K/E357Q SEQ ID NO:356
EVQLVESGGGLVKPGGSLRLSCVASGFTFSNYWMNWVRQAPGKGLEWVAEIRLYSNNYATHYAESVKGRFTISRDDSKSTLYLQMNNLKT
EDTGVYYCTRYYGNYGGYFDVWGQGTLVTVSS/ASTKGPSVFPLAPSSKSTSGGTAALGCLVKDYFPEPVTVSWNSGALTSGVHTFPAVL
QSSGLYSLSSVVTVPSSSLGTQTYICNVNHKPSDTKVDKKVEPKSSDKTHTCPPCPAPPVAGPSVFLFPPKPKDTLMISRTPEVTCVVVD
VKHEDPEVKFNWYVDGVEVHNAKTKPREEQYNSTYRVVSVLTVLHQDWLNGKEYKCKVSNKALPAPIEKTISKAKGQPREPQVYTLPPSR
EQMTKNQVKLTCLVKGFYPSDIAVEWESNGQPENNYKTTPPVLDSDGSFFLYSKLTVDKSRWQQGNVFSCSVMHEALHNHYTQKSLSLSP
GK Chain3-1G6_L1.188[PD-1] SEQ ID NO:357
EIVMTQSPATLSVSPGERVTLTCRASQSVGNDVAWYQQKPGQSPRLLINYASHRYTGVPDRFTGSGYGTEFTLTISSVQSEDFAVYFCQQ
DFSSPRTFGGGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

XENP025849human_IL15Ra(sushi)_(GGGGS)5-human_IL15(single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q

Chain 1 - 1C11[PD-1]_H3_IgG1_PVA_/S267K/S364K/E357Q SEQ ID NO:358
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK Chain2-human_IL15Ra(sushi)_(GGGGS)5-human_IL15(single-chain)_Fc(216)_IgG1_pI(-)_Isosteric_A_C220S/PVA_/S267K/L368D/K370S SEQ ID NO:359
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVNVISDLKKIEDLIQSMHIDATLYTESDVHPSCKVTAMKCFLLELQVISLESGDASIHDTVENLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSPGK Chain3-1C11[PD-1]_L3 SEQ ID NO:360
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 69B

<u>XENP024535human_IL15Ra(sushi)_(GGGGS)5-human_IL15(N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain 1 - 1C11[PD-1]_H3_ IgG1_PVA_/S267K/S364K/E357Q SEQ ID NO:361
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(N65D;single-chain)_ Fc(216)_IgG1_pI(-)_Isosteric_A_C220S/PVA_/S267K/L368D/K370S SEQ ID NO:362
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVNVISDLKKIEDLIQSMHIDATLYTESDVHPSCKVTAMKCFLLELQVISLESGDASIHDTVEDLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSPGK

Chain3-1C11[PD-1]_L3 SEQ ID NO:363
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC <u>XENP024536human_IL15Ra(sushi)_(GGGGS)5-human_IL15(Q108E;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain1-1C11[PD-1]_H3_ IgG1_PVA_/S267K/S364K/E357Q SEQ ID NO:364
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(Q108E;single-chain)_ Fc(216)_IgG1_pI(-)_Isosteric_A_C220S/PVA_/S267K/L368D/K370S SEQ ID NO:365
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVNVISDLKKIEDLIQSMHIDATLYTESDVHPSCKVTAMKCFLLELQVISLESGDASIHDTVENLIILANNSLSSNGNVTESGCKEC
EELEEKNIKEFLQSFVHIVEMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSPGK

Chain3-1C11[PD-1]_L3 SEQ ID NO:366
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 69C

<u>XENP025850human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q</u>

Chain 1 - 1C11[PD-1]_H3L3_ IgG1_PVA_/S267K/S364K/E357Q SEQ ID NO:367
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK

Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S SEQ ID NO:368
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVDVISDLKKIEDLIQSMHIDATLYTESDVHPSCKVTAMKCFLLELQVISLESGDASIHDTVEDLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVMHEALHNHYTQKSLSLSPGK

Chain3-1C11[PD-1]_L3 SEQ ID NO:369
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC <u>XENP025937human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S</u>

Chain 1 - 1C11[PD-1]_H3_ IgG1_PVA_/S267K/S364K/E357Q/M428L/N434S SEQ ID NO:370
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVLHEALHSHYTQKSLSLSPGK

Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S/M428L/N434S SEQ ID NO: 371
ITCPPPMSVEHADIWVKSYSLYSRERYICNSGFKRKAGTSSLTECVLNKATNVAHWTTPSLKCIR/GGGGSGGGGSGGGGSGGGGSGGGG
S/NWVDVISDLKKIEDLIQSMHIDATLYTESDVHPSCKVTAMKCFLLELQVISLESGDASIHDTVEDLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVLHEALHSHYTQKSLSLSPGK

Chain3-1C11[PD-1]_L3 SEQ ID NO: 372
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 70

XENP022112 1G6_H1.278_L1.188_[PD-1]_Fab-IL15(non-covalent)-human_IL15Ra(Sushi)_Fc(216)_IgG1_pI(-)_Isosteric_A_C220S/PVA_/S267K/L368D/K370S-Fc(216)_IgG1_C220S/PVA_/S267K/S364K/E357Q

Chain 1 – IL-15 SEQ ID NO: 373
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

Chain 2 – 1G6_H1.278[PD-1]_IgG1_pI(-)_Isosteric_A_C220S/PVA_/S267K/L368D/K370S SEQ ID NO: 374
EVQLVESGGGLVKPGGSLRLSCVASGFTFSNYWMNWVRQAPGKGLEWVAEIRLYSNNYATHYAESVKGRFTISRDDSKSTLYLQMNNLKT
EDTGVYYCTRYYGNYGGYFDVWGQGTLVTVSS/ASTKGPSVFPLAPSSKSTSGGTAALGCLVKDYFPEPVTVSWNSGALTSGVHTFPAVL
QSSGLYSLSSVVTVPSSSLGTQTYICNVNHKPSDTKVDKKVEPKSCDKTHTCPPCPAPPVAGPSVFLFPPKPKDTLMISRTPEVTCVVVD
VKHEDPEVKFNWYVDGVEVHNAKTKPREEEYNSTYRVVSVLTVLHQDWLNGKEYKCKVSNKALPAPIEKTISKAKGQPREPQVYTLPPSR
EEMTKNQVSLTCDVSGFYPSDIAVEWESDGQPENNYKTTPPVLDSDGSFFLYSKLTVDKSRWEQGDVFSCSVMHEALHNHYTQKSLSLSP
GK

Chain 3 - human_IL15Ra(Sushi)_Fc(216)_IgG1_C220S/PVA_/S267K/S364K/E357Q SEQ ID NO: 375
ITCPPPMSVEHADIWVKSYSLYSRERYICNSGFKRKAGTSSLTECVLNKATNVAHWTTPSLKCIR/EPKSSDKTHTCPPCPAPPVAGPSV
FLFPPKPKDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Chain 4 – 1G6_L1.188[PD-1] SEQ ID NO: 376
EIVMTQSPATLSVSPGERVTLTCRASQSVGNDVAWYQQKPGQSPRLLINYASHRYTGVPDRFTGSGYGTEFTLTISSVQSEDFAVYFCQQ
DFSSPRTFGGGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 71

XENP022641 1G6_H1.278_L1.188_[PD-1]_Fab-IL15(E87C)-human_IL15Ra(Sushi-D96/C97)_Fc(216)_IgG1_pI(-
)_Isosteric_A_C220S/PVA_/S267K/L368D/K370S-Fc(216)_IgG1_C220S/PVA_/S267K/S364K/E357Q Chain 1 – IL-15(E87C) SEQ ID NO: 377
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain2–1G6_H1.278_IgG1_pI(-)_Isosteric_A_C220S/PVA_/S267K/L368D/K370S SEQ ID NO: 378
EVQLVESGGGLVKPGGSLRLSCVASGFTFSNYWMNWVRQAPGKGLEWVAEIRLYSNNYATHYAESVKGRFTISRDDSKSTLYLQMNNLKT
EDTGVYYCTRYYGNYGGYFDVWGQGTLVTVSS/ASTKGPSVFPLAPSSKSTSGGTAALGCLVKDYFPEPVTVSWNSGALTSGVHTFPAVL
QSSGLYSLSSVVTVPSSSLGTQTYICNVNHKPSDTKVDKKVEPKSCDKTHTCPPCPAPPVAGPSVFLFPPKPKDTLMISRTPEVTCVVVD
VKHEDPEVKFNWYVDGVEVHNAKTKPREEEYNSTYRVVSVLTVLHQDWLNGKEYKCKVSNKALPAPIEKTISKAKGQPREPQVYTLPPSR
EEMTKNQVSLTCDVSGFYPSDIAVEWESDGQPENNYKTTPPVLDSDGSFFLYSKLTVDKSRWEQGDVFSCSVMHEALHNHYTQKSLSLSP
GK Chain3-human_IL15Ra(Sushi-D96/C97)_Fc(216)_IgG1_C220S/PVA_/S267K/S364K/E357Q SEQ ID NO: 379
ITCPPPMSVEHADIWVKSYSLYSRERYICNSGFKRKAGTSSLTECVLNKATNVAHWTTPSLKCIRDC/EPKSSDKTHTCPPCPAPPVAGP
SVFLFPPKPKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREQMTKNQVKLTCLVKGFYPSDIAVEWESNGQPENNYKTTPPVLDSDGSFFLYSKLTVDKSRWQ
QGNVFSCSVMHEALHNHYTQKSLSLSPGK Chain4–1G6_L1.188[PD-1] SEQ ID NO: 380
EIVMTQSPATLSVSPGERVTLTCRASQSVGNDVAWYQQKPGQSPRLLINYASHRYTGVPDRFTGSGYGTEFTLTISSVQSEDFAVYFC**QQ
DFSSPRT**FGGGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 72A

1C11[PD-1]_H3L3_H1L1_IgG1_pI(-)_Isosteric_A_C220S/PVA_/S267K/L368D/K370S_(GGGGS)2_IL15Ra(sushi)_(GGGGS)5-IL15(N4D/N65D)

Chain 1 – 1C11[PD-1]_H3_ IgG1_pI(-)_Isosteric_A_PVA_/S267K/L368D/K370S_(GGGGS)2_IL15Ra(sushi)_(GGGGS)5-IL15(N4D/N65D) SEQ ID NO: 381

QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSDTKVDKKVEPKSCDKTHTCPPCPAPPVAGPSVFLFPPKPKDTLMISRTPEVTCVVVDVKHED
PEVKFNWYVDGVEVHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYTQKSLSLSP/GGGG
GSGGGGS/ITCPPPMSVEHADIWVKSYSLYSRERYICNSGFKRKAGTSSLTECVLNKATNVAHWTTPSLKCIR/GGGGSGGGGSGGGGSG
GGGSGGGGS/NWVDVISDLKKIEDLIQSMHIDATLYTESDVHPSCKVTAMKCFLLELQVISLESGDASIHDTVEDL
IILANNSLSSNGNVTESGCKECEELEEKNIKEFLQSFVHIVQMFINTS

Chain 2 - 1C11[PD-1]_H3_ IgG1_ PVA_/S267K/S364K/E357Q SEQ ID NO: 382

QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK

Chain 3 – 1C11[PD-1]_L3 SEQ ID NO: 383

DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

1C11[PD-1]_H3L3_IgG1_pI(-)_Isosteric_A_PVA_/S267K/L368D/K370S_(GGGGS)5_IL15Ra(Sushi)_IL15(single-chain)_IgG1_pI_ISO(+RR)_/PVA_/S267K/S364K/E357Q

Chain1–1C11[PD-1]_H3_IgG1_pI(-)_Isosteric_A_PVA_/S267K/L368D/K370S__(GGGGS)5_IL15Ra(Sushi)_IL15(single-chain) SEQ ID NO: 384

QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSDTKVDKKVEPKSCDKTHTCPPCPAPPVAGPSVFLFPPKPKDTLMISRTPEVTCVVVDVKHED
PEVKFNWYVDGVEVHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYTQKSLSLSPGK/GG
GGSGGGGS/ITCPPPMSVEHADIWVKSYSLYSRERYICNSGFKRKAGTSSLTECVLNKATNVAHWTTPSLKCIR/GGGGSGGGGSGGGGS
GGGGSGGGGS/NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS

Chain2-1C11[PD-1]_H3_IgG1_pI_ISO(+RR)_/PVA_/S267K/S364K/E357Q SEQ ID NO: 385

QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTKTYTCNVNHKPSNTKVDKKVERKSCDKTHTCPRCPAPPVAGPSVFLFPPKPKDTLMISRTPEVTCVVVDVKHED
PEVKFKWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK

Chain3–1C11[PD-1]_L3 SEQ ID NO: 386

DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 72B

1C11[PD-1]_H3L3_IgG1_pI(-
)_Isosteric_A_PVA_/S267K/L368D/K370S_IgG1_pI_ISO(+RR)_/PVA_/S267K/S364K/E357Q_(GGGGS)5_IL15Ra
(Sushi)_IL15(single-chain)

Chain1–1C11[PD-1]_H3_IgG1_pI(-)_Isosteric_A_PVA_/S267K/L368D/K370S SEQ ID NO: 387
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSDTKVDKKVEPKSCDKTHTCPPCPAPPVAGPSVFLFPPKPKDTLMISRTPEVTCVVVDVKHED
PEVKFNWYVDGVEVHNAKTKPREEEYNSTYRVVSVLTVLHQDWLNGKEYKCKVSNKALPAPIEKTISKAKGQPREPQVYTLPPSREEMTK
NQVSLTCDVSGFYPSDIAVEWESDGQPENNYKTTPPVLDSDGSFFLYSKLTVDKSRWEQGDVFSCSVMHEALHNHYTQKSLSLSPGK Chain2–1C11[PD-1]_H3_
IgG1_pI_ISO(+RR)_/PVA_/S267K/S364K/E357Q_(GGGGS)5_IL15Ra(Sushi)_IL15(single-chain) SEQ ID NO:
388
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTKTYTCNVNHKPSNTKVDKKVERKSCDKTHTCPRCPAPPVAGPSVFLFPPKPKDTLMISRTPEVTCVVVDVKHED
PEVKFKWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVMHEALHNHYTQKSLSLSPGK/<u>GG
GGSGGGGS</u>/ITCPPPMSVEHADIWVKSYSLYSRERYICNSGFKRKAGTSSLTECVLNKATNVAHWTTPSLKCIR/<u>GGGGSGGGGSGGGGS
GGGGSGGGGS</u>/NWVNVISDLKKIEDLIQSMHIDATLYTESDVHPSCKVTAMKCFLLELQVISLESGDASIHDTVENLIILANNSLSSNGN
VTESGCKECEELEEKNIKEFLQSFVHIVQMFINTS Chain3–1C11[PD-1]_L3 SEQ ID NO: 389
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 73A

XENP022642 Nivolumab_H0L0_IgG1_pI(-
)_Isosteric_A_PVA_/S267K/L368D/K370S_(GGGGS)2_IL15Ra(Sushi)_IL15(non-
covalent)_IgG1_pI_ISO(+RR)_/PVA_/S267K/S364K/E357Q

Chain 1 – IL-15 SEQ ID NO: 390
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS

Chain 2 – Nivolumab_H0_IgG1_pI(-)_Isosteric_A_PVA_/S267K/L368D/K370S__(GGGGS)2_IL15Ra(Sushi) SEQ ID NO: 391
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK/GGGGSG
GGGS/ITCPPPMSVEHADIWVKSYSLYSRERYICNSGFKRKAGTSSLTECVLNKATNVAHWTTPSLKCIR

Chain 3 – Nivolumab_H0_IgG1_pI_ISO(+RR)_/PVA_/S267K/S364K/E357Q SEQ ID NO: 392
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTKTYTCNVNHKPSNTKVDKKVERKSCDKTHTCPRCPAPPVAGPSVFLFPPKPKDTLMISRTPEVTCVVVDVKHEDPEVK
FKWYVDGVEVHNAKTKPREEQYNSTYRVVSVLTVLHQDWLNGKEYKCKVSNKALPAPIEKTISKAKGQPREPQVYTLPPSREQMTKNQVK
LTCLVKGFYPSDIAVEWESNGQPENNYKTTPPVLDSDGSFFLYSKLTVDKSRWQQGNVFSCSVMHEALHNHYTQKSLSLSPGK

Chain 4 – Nivolumab_L0 SEQ ID NO: 393
EIVLTQSPATLSLSPGERATLSCRASQSVSSYLAWYQQKPGQAPRLLIYDASNRATGIPARFSGSGSGTDFTLTISSLEPEDFAVYYCQQ
SSNWPRTFGQGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 73B

XENP022643 Nivolumab_H0L0_IgG1_pI(-
)_Isosteric_A_PVA_/S267K/L368D/K370S_IgG1_pI_ISO(+RR)_/PVA_/S267K/S364K/E357Q_(GGGGS)2_IL15Ra
(Sushi)_IL15(non-covalent)

Chain1-IL-15 SEQ ID NO: 394
NWVNVISDLKKIEDLIQSMHIDATLYTESDVHPSCKVTAMKCFLLELQVISLESGDASIHDTVENLIILANNSLSSNGNVTESGCKECEE
LEEKNIKEFLQSFVHIVQMFINTS Chain2-Nivolumab_H0_IgG1_pI(-)_Isosteric_A_PVA_/S267K/L368D/K370S SEQ ID NO: 395
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK Chain3-Nivolumab_H0_IgG1_pI_ISO(+RR)_/PVA_/S267K/S364K/E357Q_(GGGGS)2_IL15Ra(Sushi) SEQ ID NO:
396
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTKTYTCNVNHKPSNTKVDKKVERKSCDKTHTCPRCPAPPVAGPSVFLFPPKPKDTLMISRTPEVTCVVVDVKHEDPEVK
FKWYVDGVEVHNAKTKPREEQYNSTYRVVSVLTVLHQDWLNGKEYKCKVSNKALPAPIEKTISKAKGQPREPQVYTLPPSREQMTKNQVK
LTCLVKGFYPSDIAVEWESNGQPENNYKTTPPVLDSDGSFFLYSKLTVDKSRWQQGNVFSCSVMHEALHNHYTQKSLSLSPGK/GGGGSG
GGGS/ITCPPPMSVEHADIWVKSYSLYSRERYICNSGFKRKAGTSSLTECVLNKATNVAHWTTPSLKCIR Chain4-Nivolumab_L0 SEQ ID NO: 397
EIVLTQSPATLSLSPGERATLSCRASQSVSSYLAWYQQKPGQAPRLLIYDASNRATGIPARFSGSGSGTDFTLTISSLEPEDFAVYYC**QQ
SSNWPRT**FGQGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 74A

XENP022644 Nivolumab_H0L0_IgG1_pI(-)_Isosteric_A_PVA_/S267K/L368D/K370S_(GGGGS)2_IL15Ra(Sushi-D96/C97)_IL15(E87C)_IgG1_pI_ISO(+RR)_/PVA_/S267K/S364K/E357Q Chain 1 – IL-15(E87C) SEQ ID NO: 398
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS Chain2-Nivolumab_H0_IgG1_pI(-)_Isosteric_A_PVA_/S267K/L368D/K370S_(GGGGS)2_IL15Ra(Sushi-D96/C97)
SEQ ID NO: 399
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK/GGGGSG
GGGS/ITCPPPMSVEHADIWVKSYSLYSRERYICNSGFKRKAGTSSLTECVLNKATNVAHWTTPSLKCIRDC Chain3-Nivolumab_H0_IgG1_pI_ISO(+RR)_/PVA_/S267K/S364K/E357Q SEQ ID NO:400
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTKTYTCNVNHKPSNTKVDKKVERKSCDKTHTCPRCPAPPVAGPSVFLFPPKPKDTLMISRTPEVTCVVVDVKHEDPEVK
FKWYVDGVEVHNAKTKPREEQYNSTYRVVSVLTVLHQDWLNGKEYKCKVSNKALPAPIEKTISKAKGQPREPQVYTLPPSREQMTKNQVK
LTCLVKGFYPSDIAVEWESNGQPENNYKTTPPVLDSDGSFFLYSKLTVDKSRWQQGNVFSCSVMHEALHNHYTQKSLSLSPGK Chain4–Nivolumab_L0 SEQ ID NO: 401
EIVLTQSPATLSLSPGERATLSCRASQSVSSYLAWYQQKPGQAPRLLIYDASNRATGIPARFSGSGSGTDFTLTISSLEPEDFAVYYC**QQ
SSNWPRT**FGQGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 74B

XENP022645 Nivolumab_H0L0_IgG1_pI(-)_Isosteric_A_PVA_/S267K/L368D/K370S_IgG1_pI_ISO(+RR)_/PVA_/S267K/S364K/E357Q_(GGGGS)2_IL15Ra(Sushi-D96/C97)_IL15(E87C)

Chain 1 – IL-15(E87C) SEQ ID NO: 402
NWVNVISDLKKIEDLIQSMHIDATLYTESDVHPSCKVTAMKCFLLELQVISLESGDASIHDTVENLIILANNSLSSNGNVTESGCKCCEE
LEEKNIKEFLQSFVHIVQMFINTS

Chain2-Nivolumab_H0_IgG1_pI(-)_Isosteric_A_PVA_/S267K/L368D/K370S SEQ ID NO: 403
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTQTYICNVNHKPSDTKVDKKVEPKSCDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVYTLPPSREEMTKNQVS
LTCDVSGFYPSDIAVEWESDGQPENNYKTTPPVLDSDGSFFLYSKLTVDKSRWEQGDVFSCSVMHEALHNHYTQKSLSLSPGK

Chain3-Nivolumab_H0_IgG1_pI_ISO(+RR)_/PVA_/S267K/S364K/E357Q_(GGGGS)2_IL15Ra(Sushi-D96/C97)
SEQ ID NO: 404
QVQLVESGGGVVQPGRSLRLDCKASGITFSNSGMHWVRQAPGKGLEWVAVIWYDGSKRYYADSVKGRFTISRDNSKNTLFLQMNSLRAED
TAVYYCATNDDYWGQGTLVTVSS/ASTKGPSVFPLAPSSKSTSGGTAALGCLVKDYFPEPVTVSWNSGALTSGVHTFPAVLQSSGLYSLS
SVVTVPSSSLGTKTYTCNVNHKPSNTKVDKKVERKSCDKTHTCPRCPAPPVAGPSVFLFPPKPKDTLMISRTPEVTCVVVDVKHEDPEVK
FKWYVDGVEVHNAKTKPREEQYNSTYRVVSVLTVLHQDWLNGKEYKCKVSNKALPAPIEKTISKAKGQPREPQVYTLPPSREQMTKNQVK
LTCLVKGFYPSDIAVEWESNGQPENNYKTTPPVLDSDGSFFLYSKLTVDKSRWQQGNVFSCSVMHEALHNHYTQKSLSLSPGK/GGGGSG
GGGS/ITCPPPMSVEHADIWVKSYSLYSRERYICNSGFKRKAGTSSLTECVLNKATNVAHWTTPSLKCIRDC

Chain4–Nivolumab_L0 SEQ ID NO: 405
EIVLTQSPATLSLSPGERATLSCRASQSVSSYLAWYQQKPGQAPRLLIYDASNRATGIPARFSGSGSGTDFTLTISSLEPEDFAVYYCQQ
SSNWPRTFGQGTKVEIK/RTVAAPSVFIFPPSDEQLKSGTASVVCLLNNFYPREAKVQWKVDNALQSGNSQESVTEQDSKDSTYSLSSTL
TLSKADYEKHKVYACEVTHQGLSSPVTKSFNRGEC

Figure 75

1C11[PD-1]_H3L3_bivalent_IL15_N4D/N65D_IL15Ra(sushi)_(GGGGS)1_Fc(216)_IgG1_pI(-)_Isosteric_A_C220S/PVA_/S267K/L368D/K370S_Fc(216)_IgG1_C220S/PVA_/S267K/S364K/E357Q

Chain 1 - 1C11[PD-1]_H3_IL15_N4D/N65D_(GGGGS)1_Fc(216)_IgG1_pI(-)_Isosteric_A_C220S/PVA_/S267K/L368D/K370S SEQ ID NO: 406
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSC/GGGGSGGGGS/NWVDVISDLKK
IEDLIQSMHIDATLYTESDVHPSCKVTAMKCFLLELQVISLESGDASIHDTVEDLIILANNSLSSNGNVTESGCK
ECEELEEKNIKEFLQSFVHIVQMFINTS/GGGGS/EPKSSDKTHTCPPCPAPPVAGPSVFLFPPKPKDTLMISRT
PEVTCVVVDVKHEDPEVKFNWYVDGVEVHNAKTKPREEEYNSTYRVVSVLTVLHQDWLNGKEYKCKVSNKALPAP
IEKTISKAKGQPREPQVYTLPPSREEMTKNQVSLTCDVSGFYPSDIAVEWESDGQPENNYKTTPPVLDSDGSFFL
YSKLTVDKSRWEQGDVFSCSVMHEALHNHYTQKSLSLSPGK Chain 2 - 1C11[PD-1]_H3_IL15Ra(sushi)_(GGGGS)1_Fc(216)_IgG1_C220S/PVA_/S267K/S364K/E357Q SEQ ID NO: 407
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSC/GGGGSGGGGS/ITCPPPMSVEH
ADIWVKSYSLYSRERYICNSGFKRKAGTSSLTECVLNKATNVAHWTTPSLKCIR/GGGGS/EPKSSDKTHTCPPC
PAPPVAGPSVFLFPPKPKDTLMISRTPEVTCVVVDVKHEDPEVKFNWYVDGVEVHNAKTKPREEQYNSTYRVVSV
LTVLHQDWLNGKEYKCKVSNKALPAPIEKTISKAKGQPREPQVYTLPPSREQMTKNQVKLTCLVKGFYPSDIAVE
WESNGQPENNYKTTPPVLDSDGSFFLYSKLTVDKSRWQQGNVFSCSVMHEALHNHYTQKSLSLSPGK Chain 3 - 1C11[PD-1]_L3 SEQ ID NO: 408
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 76

1C11[PD-1]_H3L3_Fab-IL15Ra(sushi)_(GGGGS)5-IL15(N4D/N65D)-1C11[PD-1]_H3L3_Fab_Fc(216)_IgG1_pI(-)_Isosteric_A_C220S/PVA_/S267K/L368D/K370S_IgG1_C220S/PVA_/S267K/S364K/E357Q

Chain 1 - 1C11[PD-1]_H3_IL15Ra(sushi)_(GGGGS)5-IL15(N4D/N65D)_IgG1_pI(-)_Isosteric_A_C220S/PVA_/S267K/L368D/K370S SEQ ID NO: 409
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYGSSPYWGQGTLVTVSS/ASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSC/<u>GGGGSGGGGS</u>/ITCPPPMSVEH
ADIWVKSYSLYSRERYICNSGFKRKAGTSSLTECVLNKATNVAHWTTPSLKCIR/<u>GGGGSGGGGSGGGGSGGGGS</u>
<u>GGGGS</u>/NWVDVISDLKKIEDLIQSMHIDATLYTESDVHPSCKVTAMKCFLLELQVISLESGDASIHDTVEDLIILANNSLSSNGNVTES
GCKECEELEEKNIKEFLQSFVHIVQMFINTS/EPKSSDKTHTCPPCPAPPVAGPSVFLFPPKPKDTLMISRTPEVTCVVV
DVKHEDPEVKFNWYVDGVEVHNAKTKPREEEYNSTYRVVSVLTVLHQDWLNGKEYKCKVSNKALPAPIEKTISKA
KGQPREPQVYTLPPSREEMTKNQVSLTCDVSGFYPSDIAVEWESDGQPENNYKTTPPVLDSDGSFFLYSKLTVDK
SRWEQGDVFSCSVMHEALHNHYTQKSLSLSPGK Chain 2 - 1C11[PD-1]_H3_IgG1_C220S/PVA_/S267K/S364K/E357Q SEQ ID NO: 410
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYGSSPYWGQGTLVTVSS/ASTKGPSVFPLAPSSKSTSGGTAALGCLVKDYFPEPVTVSWNSGALTSGVH
TFPAVLQSSGLYSLSSVVTVPSSSLGTQTYICNVNHKPSNTKVDKKVEPKSCDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEY
KCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK Chain 3 – 1C11[PD-1]_L3 SEQ ID NO: 411
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

Figure 77A
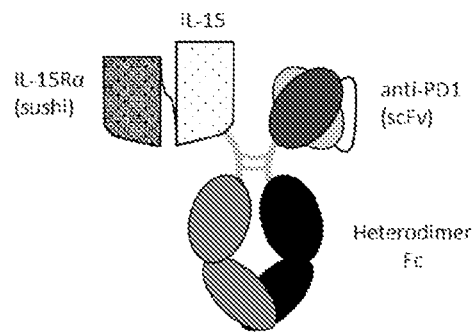
Figure 77B
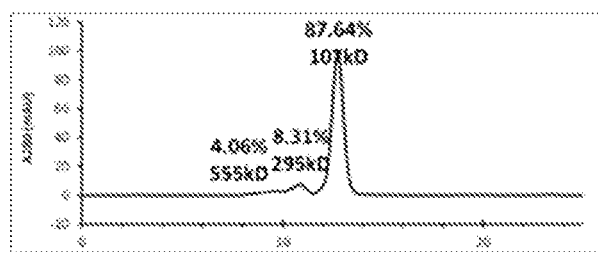
pI(MW) = 7.32 (101.0 kDa)
Protein A yield = 33.6 mg/L
Figure 77C
Reducing
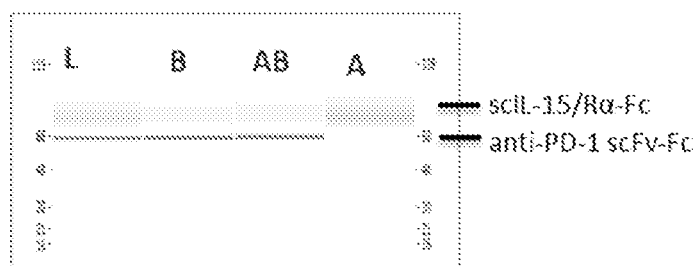
Non Reducing
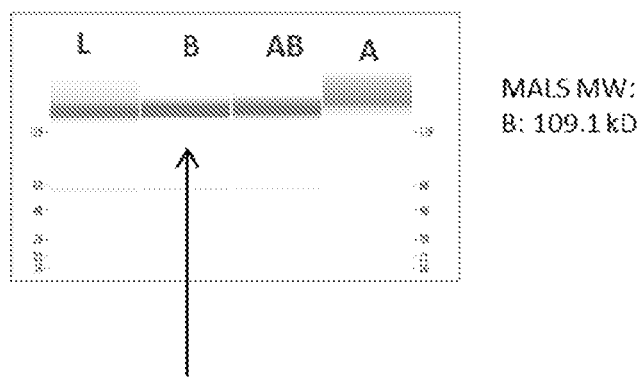
Purified
XENP21480

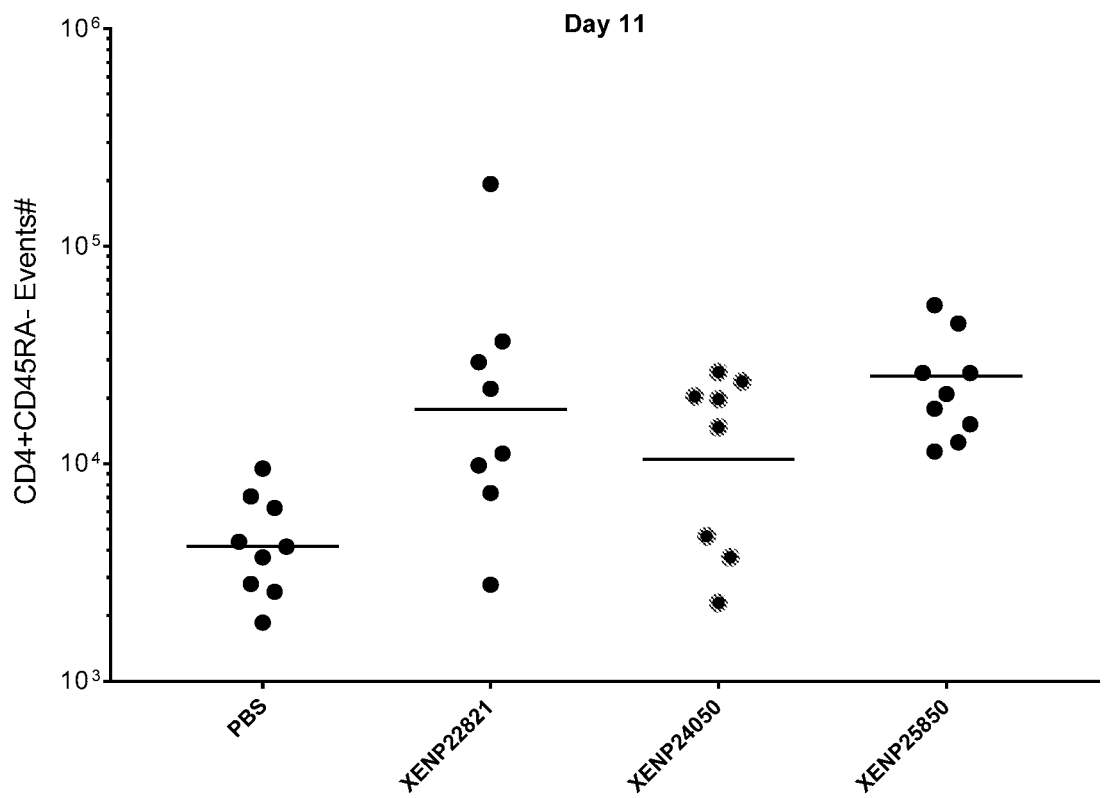

Figure 86

XENP016432 Nivolumab_H0L0_IgG1_PVA_/S267K Heavy Chain SEQ ID NO: 412

QVQLVESGGGVVQPGRSLRLDCKASGITFSNSGMHWVRQAPGKGLEWVAVIWYDGSKRYYADSVKGRFTISRDNS
KNTLFLQMNSLRAEDTAVYYCATNDDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNHYTQKSLSLSPGK

XENP016432 Nivolumab_H0L0_IgG1_PVA_/S267K Light Chain SEQ ID NO:413

EIVLTQSPATLSLSPGERATLSCRASQSVSSYLAWYQQKPGQAPRLLIYDASNRATGIPARFSGSGSGTDFTLTI
SSLEPEDFAVYYCQQSSNWPRTFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC

Figure 87

>XENP025951 empty-Fc-1C11[PD-1]_H3L3_IgG1_Fc(216)_IgG1_pI(-
)_Isosteric_A_C220S/PVA_/S267K/L368D/K370S-IgG1_PVA_/S267K/S364K/E357Q >XENP025951 empty_Fc(216)_IgG1_pI(-)_Isosteric_A_C220S/PVA_/S267K/L368D/K370S SEQ ID NO: 414
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK >XENP025951 1C11[PD-1]_H3L3_IgG1_PVA_/S267K/S364K/E357Q Fab-Fc Heavy Chain SEQ ID NO: 415
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK >XENP025951 1C11[PD-1]_H3L3 Light Chain SEQ ID NO: 416
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 93A

>XENP022538 1C11[PD-1]_H3L3_scFv(GKPGS)4 (SEQ ID NO: 417)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQA
EDVAVYCFQGSHVPNTFGGGTKVEIK

>XENP023577 1C11_H3_L3.1_scFv(GKPGS)4 (SEQ ID NO: 418)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DILMTQSPDSL
AVSLGERATINCKSSQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023579 1C11_H3_L3.3_scFv(GKPGS)4 (SEQ ID NO: 419)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERATINCKSSQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023589 1C11_H3_L3.15_scFv(GKPGS)4 (SEQ ID NO: 420)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
SVSLGERATINCKSSQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023601 1C11_H3_L3.23_scFv(GKPGS)4 (SEQ ID NO: 421)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERVTINCKSSQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023605 1C11_H3_L3.28_scFv(GKPGS)4 (SEQ ID NO: 422)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCRSSQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023609 1C11_H3_L3.32_scFv(GKPGS)4 (SEQ ID NO: 423)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKASQSIVHSNGNTYLEWYQQKPGQSPKLLIYKVSNRFSGVPDRFSGSGSGTDFTLTISSLQAE
DVAVYCFQGSHVPNTFGGGTKVEIK

>XENP023615 1C11_H3_L3.46_scFv(GKPGS)4 (SEQ ID NO: 424)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQPPKLLIYKVSNRFSGVPDRFSGSGSGTDFTLTISSLQAE
DVAVYCFQGSHVPNTFGGGTKVEIK

>XENP023616 1C11_H3_L3.47_scFv(GKPGS)4 (SEQ ID NO: 425)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQAPKLLIYKVSNRFSGVPDRFSGSGSGTDFTLTISSLQAE
DVAVYCFQGSHVPNTFGGGTKVEIK

>XENP023624 1C11_H3_L3.57_scFv(GKPGS)4 (SEQ ID NO: 426)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFTGVPDRFSGSGSGTDFTLTISSLQAE
DVAVYCFQGSHVPNTFGGGTKVEIK

Figure 93B

\>XENP023626 1C11_H3_L3.59_scFv(GKPGS)4 (SEQ ID NO: 427)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISRLQAE
DVAVYYCFQGSHVPNTFGGGTKVEIK

\>XENP023628 1C11_H3_L3.62_scFv(GKPGS)4 (SEQ ID NO: 428)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSMQAE
DVAVYYCFQGSHVPNTFGGGTKVEIK

\>XENP023629 1C11_H3_L3.63_scFv(GKPGS)4 (SEQ ID NO: 429)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSVQAE
DVAVYYCFQGSHVPNTFGGGTKVEIK

\>XENP023633 1C11_H3_L3.69_scFv(GKPGS)4 (SEQ ID NO: 430)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DAAVYYCFQGSHVPNTFGGGTKVEIK

\>XENP023636 1C11_H3_L3.73_scFv(GKPGS)4 (SEQ ID NO: 431)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVATYYCFQGSHVPNTFGGGTKVEIK

\>XENP023640 1C11_H3_L3.81_scFv(GKPGS)4 (SEQ ID NO: 432
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGQGTKVEIK

\>XENP023755 1C11_H3.1_L3_scFv(GKPGS)4 (SEQ ID NO: 433)
QVQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP023758 1C11_H3.5_L3_scFv(GKPGS)4 (SEQ ID NO: 434)
QIQLVQSGAELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP023760 1C11_H3.7_L3_scFv(GKPGS)4 (SEQ ID NO: 435)
QIQLVQSGPELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP023765 1C11_H3.18_L3_scFv(GKPGS)4 (SEQ ID NO: 436)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE

Figure 93C

>XENP023770 1C11_H3.25_L3_scFv(GKPGS)4 (SEQ ID NO: 437)
QIQLVQSGSELKKPGASVKVSCKASGYTFTHYGMNWVRQAPGQGLEWMGWINTNTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023776 1C11_H3.35_L3_scFv(GKPGS)4 (SEQ ID NO: 438)
QIQLVQSGSELKKPGASVKVSCKASGYTFTHYGMNWVRQAPGQGLEWMGWINTYTGEPTYADKFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023779 1C11_H3.41_L3_scFv(GKPGS)4 (SEQ ID NO: 439)
QIQLVQSGSELKKPGASVKVSCKASGYTFTHYGMNWVRQAPGQGLEWMGWINTYTGEPTYADGFKGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023780 1C11_H3.42_L3_scFv(GKPGS)4 (SEQ ID NO: 440)
QIQLVQSGSELKKPGASVKVSCKASGYTFTHYGMNWVRQAPGQGLEWMGWINTYTGEPTYADGFQGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023781 1C11_H3.43_L3_scFv(GKPGS)4 (SEQ ID NO: 441)
QIQLVQSGSELKKPGASVKVSCKASGYTFTHYGMNWVRQAPGQGLEWMGWINTYTGEPTYADGFTGRVVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023786 1C11_H3.50_L3_scFv(GKPGS)4 (SEQ ID NO: 442)
QIQLVQSGSELKKPGASVKVSCKASGYTFTHYGMNWVRQAPGQGLEWMGWINTYTGEPTYADGFTGRFVFSADTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023793 1C11_H3.59_L3_scFv(GKPGS)4 (SEQ ID NO: 443)
QIQLVQSGSELKKPGASVKVSCKASGYTFTHYGMNWVRQAPGQGLEWMGWINTYTGEPTYADGFTGRFVFSLDTS
QSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023796 1C11_H3.62_L3_scFv(GKPGS)4 (SEQ ID NO: 444)
QIQLVQSGSELKKPGASVKVSCKASGYTFTHYGMNWVRQAPGQGLEWMGWINTYTGEPTYADGFTGRFVFSLDTS
VSTIYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP023811 1C11_H3.74_L3_scFv(GKPGS)4 (SEQ ID NO: 445)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93D

>XENP024201 1C11_H3_L3.113_scFv(GKPGS)4 (SEQ ID NO: 446)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGKSPKLLIYKVSNRFSGVPDRFSGSGSGTDFTLTISSLQAE
DVAVYYCFQGSHVPNTFGGGTKVEIK

>XENP024207 1C11_H3_L3.122_scFv(GKPGS)4 (SEQ ID NO: 447)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGIPDRFSGSGSGTDFTLTISSLQAE
DVAVYYCFQGSHVPNTFGGGTKVEIK

>XENP024208 1C11_H3_L3.124_scFv(GKPGS)4 (SEQ ID NO: 448)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPARFSGSGSGTDFTLTISSLQAE
DVAVYYCFQGSHVPNTFGGGTKVEIK

>XENP024209 1C11_H3_L3.125_scFv(GKPGS)4 (SEQ ID NO: 449)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSVEAE
DVAVYYCFQGSHVPNTFGGGTKVEIK

>XENP024210 1C11_H3_L3.132_scFv(GKPGS)4 (SEQ ID NO: 450)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGPGTKVEIK

>XENP024211 1C11_H3.78_L3_scFv(GKPGS)4 (SEQ ID NO: 451)
QIQLVQSGPELKKPGASVKVSCKASGYTFTHYGMNWVRQAPGQGLEWMGWINTNTGEPTYADGFTGRFVFSVDTS
QSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024212 1C11_H3.80_L3_scFv(GKPGS)4 (SEQ ID NO: 452)
QIQLVQSGSELKKPGASVKVSCKASGYTFTHYGMNWVRQAPGQGLEWMGWINTNTGEPTYADGFTGRFVFSVDTS
QSTAYLQISSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024213 1C11_H3.81_L3_scFv(GKPGS)4 (SEQ ID NO: 453)
QIQLVQSGSELKKPGASVKVSCKASGYTFTHYGMNWVRQAPGQGLEWMGWINTYTGEPTYADKFKGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024214 1C11_H3.82_L3_scFv(GKPGS)4 (SEQ ID NO: 454)
QIQLVQSGSELKKPGASVKVSCKASGYTFTHYGMNWVRQAPGQGLEWMGWINTYTGEPTYADKFQGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024215 1C11_H3.83_L3_scFv(GKPGS)4 (SEQ ID NO: 455)
QIQLVQSGSELKKPGASVKVSCKASGYTFTHYGMNWVRQAPGQGLEWMGWINTNTGEPTYADGFTGRFVFSVDTS
QSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93E

>XENP024216 1C11_H3.84_L3_scFv(GKPGS)4 (SEQ ID NO: 456)
QIQLVQSGSELKKPGASVKVSCKASGYTFTHYGMNWVRQAPGQGLEWMGWINTYTGEPTYADKFKGRFVFSLDTS
QSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024217 1C11_H3.85_L3_scFv(GKPGS)4 (SEQ ID NO: 457)
QIQLVQSGSELKKPGASVKVSCKASGYTFTHYGMNWVRQAPGQGLEWMGWINTYTGEPTYADKFQGRFVFSLDTS
QSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024218 1C11_H3.86_L3_scFv(GKPGS)4 (SEQ ID NO: 458)
EIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024221 1C11_H3.90_L3_scFv(GKPGS)4 (SEQ ID NO: 459)
QIQLVQSGSVLKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024222 1C11_H3.91_L3_scFv(GKPGS)4 (SEQ ID NO: 460)
QIQLVQSGSELVKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024226 1C11_H3.95_L3_scFv(GKPGS)4 (SEQ ID NO: 461)
QIQLVQSGSELKKPGGSVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024227 1C11_H3.96_L3_scFv(GKPGS)4 (SEQ ID NO: 462)
QIQLVQSGSELKKPGQSVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024228 1C11_H3.97_L3_scFv(GKPGS)4 (SEQ ID NO: 463)
QIQLVQSGSELKKPGESVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024247 1C11_H3.120_L3_scFv(GKPGS)4 (SEQ ID NO: 464)
QIQLVQSGSELKKPGASVKVSCKASGYTFTHYGINWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024250 1C11_H3.125_L3_scFv(GKPGS)4 (SEQ ID NO: 465)
QIQLVQSGSELKKPGASVKVSCKASGYTFTHYGMNWVRQPPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93F

>XENP024254 1C11_H3.129_L3_scFv(GKPGS)4 (SEQ ID NO: 466)
QIQLVQSGSELKKPGASVKVSCKASGYTFTHYGMNWVRQAPGQGLEWIGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024256 1C11_H3.134_L3_scFv(GKPGS)4 (SEQ ID NO: 467)
QIQLVQSGSELKKPGASVKVSCKASGYTFTHYGMNWVRQAPGQGLEWMGWINTKTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024263 1C11_H3.143_L3_scFv(GKPGS)4 (SEQ ID NO: 468)
QIQLVQSGSELKKPGASVKVSCKASGYTFTHYGMNWVRQAPGQGLEWMGWINTYTGEPYYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024266 1C11_H3.146_L3_scFv(GKPGS)4 (SEQ ID NO: 469)
QIQLVQSGSELKKPGASVKVSCKASGYTFTHYGMNWVRQAPGQGLEWMGWINTYTGEPTYAPGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024267 1C11_H3.147_L3_scFv(GKPGS)4 (SEQ ID NO: 470)
QIQLVQSGSELKKPGASVKVSCKASGYTFTHYGMNWVRQAPGQGLEWMGWINTYTGEPTYATGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024268 1C11_H3.148_L3_scFv(GKPGS)4 (SEQ ID NO: 471)
QIQLVQSGSELKKPGASVKVSCKASGYTFTHYGMNWVRQAPGQGLEWMGWINTYTGEPTYAQKFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024270 1C11_H3.150_L3_scFv(GKPGS)4 (SEQ ID NO: 472)
QIQLVQSGSELKKPGASVKVSCKASGYTFTHYGMNWVRQAPGQGLEWMGWINTYTGEPTYADGFTERFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024274 1C11_H3.154_L3_scFv(GKPGS)4 (SEQ ID NO: 473)
QIQLVQSGSELKKPGASVKVSCKASGYTFTHYGMNWVRQAPGQGLEWMGWINTYTGEPTYADGFTGRFVFSIDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024278 1C11_H3.158_L3_scFv(GKPGS)4 (SEQ ID NO: 474)
QIQLVQSGSELKKPGASVKVSCKASGYTFTHYGMNWVRQAPGQGLEWMGWINTYTGEPTYADGFTGRFVFSLDTS
VNTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024279 1C11_H3.159_L3_scFv(GKPGS)4 (SEQ ID NO: 475)
QIQLVQSGSELKKPGASVKVSCKASGYTFTHYGMNWVRQAPGQGLEWMGWINTYTGEPTYADGFTGRFVFSLDTS
VDTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93G

>XENP024287 1C11_H3.168_L3_scFv(GKPGS)4 (SEQ ID NO: 476)
QIQLVQSGSELKKPGASVKVSCKASGYTFTHYGMNWVRQAPGQGLEWMGWINTYTGEPTYADGFTGRFVFSLDTS
VSTAYLQINSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024291 1C11_H3.172_L3_scFv(GKPGS)4 (SEQ ID NO: 477)
QIQLVQSGSELKKPGASVKVSCKASGYTFTHYGMNWVRQAPGQGLEWMGWINTYTGEPTYADGFTGRFVFSLDTS
VSTAYLQISSLKPEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024372 1C11_H3_L3.86_scFv(GKPGS)4 (SEQ ID NO: 478)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFTGVPDRFSGSGSGTDFTLTISSVQAE
DVATYYCFQGSHVPNTFGQGTKVEIK

>XENP024373 1C11_H3_L3.87_scFv(GKPGS)4 (SEQ ID NO: 479)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERVTINCKASQSIVHSNGNTYLEWYQQKPGQPPKLLIYKVSNRFSGVPDRFSGSGSGTDFTLTISSLQAE
DVAVYYCFQGSHVPNTFGGGTKVEIK

>XENP024374 1C11_H3_L3.90_scFv(GKPGS)4 (SEQ ID NO: 480)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERATINCKASQSIVHSNGNTYLEWYQQKPGQPPKLLIYKVSNRFSGVPDRFSGSGSGTDFTLTISSVQAE
DAATYYCFQGSHVPNTFGQGTKVEIK

>XENP024375 1C11_H3_L3.92_scFv(GKPGS)4 (SEQ ID NO: 481)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFTGVPDRFSGSGSGTDFTLTISSLQAE
DVAVYYCFQGSHVPNTFGGGTKVEIK

>XENP024376 1C11_H3_L3.94_scFv(GKPGS)4 (SEQ ID NO: 482)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DILMTQSPDSL
AVSLGERATINCKSSQSIVHSNGNTYLEWYQQKPGQPPKLLIYKVSNRFTGVPDRFSGSGSGTDFTLTISSVQAE
DAATYYCFQGSHVPNTFGQGTKVEIK

>XENP024377 1C11_H3_L3.96_scFv(GKPGS)4 (SEQ ID NO: 483)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERATINCKASQSIVHSNGNTYLEWYQQKPGQPPKLLIYKVSNRFTGVPDRFSGSGSGTDFTLTISSVQAE
DAATYYCFQGSHVPNTFGQGTKVEIK

>XENP024378 1C11_H3_L3.105_scFv(GKPGS)4 (SEQ ID NO: 484)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
PVTPGEPATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024379 1C11_H3_L3.129_scFv(GKPGS)4 (SEQ ID NO: 485)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTINSLQAE
DAATYYCHQGSHVPNTFGGGTKVEIK

Figure 93H

>XENP024380 1C11_H3.176_L3.92_scFv(GKPGS)4 (SEQ ID NO: 486)
QIQLVQSGPELKKPGASVKVSCKASGYTFTHYGMNWVKQAPGQGLEWMGWINTNTGEPTYADKFTGRVVFSLDTS
QSTIYLQISSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFTGVPDRFSGSGSGTDFTLTISSLQAE
DVAVYYCFQGSHVPNTFGGGTKVEIK

>XENP024381 1C11_H3.176_L3.94_scFv(GKPGS)4 (SEQ ID NO: 487)
QIQLVQSGPELKKPGASVKVSCKASGYTFTHYGMNWVKQAPGQGLEWMGWINTNTGEPTYADKFTGRVVFSLDTS
QSTIYLQISSLKAEDTAVYYCARDYYGSSPYWGQGTLVTVSS/GKPGSGKPGSGKPGSGKPGS/DILMTQSPDSL
AVSLGERATINCKSSQSIVHSNGNTYLEWYQQKPGQSPKLLIYKVSNRFTGVPDRFSGSGSGTDFTLTISSVQAE
DAATYYCFQGSHVPNTFGQGTKVEIK

>XENP024382 1C11_H3.176_L3.96_scFv(GKPGS)4 (SEQ ID NO: 488)
QIQLVQSGPELKKPGASVKVSCKASGYTFTHYGMNWVKQAPGQGLEWMGWINTNTGEPTYADKFTGRVVFSLDTS
QSTIYLQISSLKAEDTAVYYCARDYYGSSPYWGQGTLVTVSS/GKPGSGKPGSGKPGSGKPGS/DIVMTQSPDSL
AVSLGERATINCKASQSIVHSNGNTYLEWYQQKPGQPPKLLIYKVSNRFTGVPDRFSGSGSGTDFTLTISSVQAE
DAATYYCFQGSHVPNTFGQGTKVEIK

>XENP024414 1C11[PD-1]_H3_L3.133_scFv(GKPGS)4 (SEQ ID NO: 489)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERVTINCKASQSIVHSNGNTYLEWYQQKPGQPPKLLIYKVSNRFSGVPDRFSGSGSGTDFTLTISSVQAE
DAATYYCFQGSHVPNTFGQGTKVEIK

>XENP024415 1C11[PD-1]_H3_L3.134_scFv(GKPGS)4 (SEQ ID NO: 490)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

>XENP024416 1C11[PD-1]_H3_L3.135_scFv(GKPGS)4 (SEQ ID NO: 491)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERVTINCKASQSIVHSNGNTYLEWYQQKPGQPPKLLIYKVSNRFSGVPDRFSGSGSGTDFTLTISSMQAE
DAATYYCFQGSHVPNTFGQGTKVEIK

>XENP024417 1C11[PD-1]_H3_L3.136_scFv(GKPGS)4 (SEQ ID NO: 492)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERITINCKASQSIVHSNGNTYLEWYQQKPGQPPKLLIYKVSNRFSGVPDRFSGSGSGTDFTLTISSMQAE
DAATYYCFQGSHVPNTFGQGTKVEIK

>XENP024418 1C11[PD-1]_H3_L3.137_scFv(GKPGS)4 (SEQ ID NO: 493)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERITINCKASQSIVHSNGNTYLEWYQQKPGQPPKLLIYKVSNRFSGVPDRFSGSGSGTDFTLTISSVQAE
DAATYYCFQGSHVPNTFGQGTKVEIK

>XENP024419 1C11[PD-1]_H3_L3.138_scFv(GKPGS)4 (SEQ ID NO: 494)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERITINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

Figure 93I

>XENP024420 1C11[PD-1]_H3_L3.139_scFv(GKPGS)4 (SEQ ID NO: 495)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVVMTQSPDSL
AVSLGERATINCKASQSIVHSNGNTYLEWYQQKPGQPPKLLIYKVSNRFSGIPDRFSGSGSGTDFTLTISSVQAE
DAATYYCFQGSHVPNTFGQGTKVEIK

>XENP024421 1C11[PD-1]_H3_L3.140_scFv(GKPGS)4 (SEQ ID NO: 496)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERATINCKASQSIVHSNGNTYLEWYQQKPGQSPKLLIYKVSNRFSGVPDRFSGSGSGTDFTLTISSVEAE
DVATYYCFQGSHVPNTFGQGTKVEIK

>XENP024422 1C11[PD-1]_H3_L3.141_scFv(GKPGS)4 (SEQ ID NO: 497)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERATINCKASQSIVHSNGNTYLEWYQQKPGQPPKLLIYKVSNRFSGVPDRFSGSGSGTDFTLTISSVEAE
DVATYYCFQGSHVPNTFGQGTKVEIK

>XENP024423 1C11[PD-1]_H3_L3.142_scFv(GKPGS)4 (SEQ ID NO: 498)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERATINCKASQSIVHSNGNTYLEWYQQKPGQAPKLLIYKVSNRFSGVPDRFSGSGSGTDFTLTISSVEAE
DVATYYCFQGSHVPNTFGQGTKVEIK

>XENP024424 1C11[PD-1]_H3.176_L3_scFv(GKPGS)4 (SEQ ID NO: 499)
QIQLVQSGSELKKPGASVKVSCKASGYTFTHYGMNWVRQAPGQGLEWMGWINTYTGEPTYAPGFKGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024425 1C11[PD-1]_H3.177_L3_scFv(GKPGS)4 (SEQ ID NO: 500)
QIQLVQSGSELKKPGASVKVSCKASGYTFTHYGMNWVRQAPGQGLEWMGWINTYTGEPTYAPKFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024426 1C11[PD-1]_H3.178_L3_scFv(GKPGS)4 (SEQ ID NO: 501)
QIQLVQSGSELKKPGASVKVSCKASGYTFTHYGMNWVRQAPGQGLEWMGWINTYTGEPTYAPGFKERFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024427 1C11[PD-1]_H3.179_L3_scFv(GKPGS)4 (SEQ ID NO: 502)
QIQLVQSGSELKKPGASVKVSCKASGYTFTHYGMNWVRQAPGQGLEWMGWINTYTGEPTYAPKFTERFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024428 1C11[PD-1]_H3.180_L3_scFv(GKPGS)4 (SEQ ID NO: 503)
QIQLVQSGSELKKPGASVKVSCKASGYTFTHYGINWVRQAPGQGLEWMGWINTYTGEPTYADGFTGRFVFSVDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93J

>XENP024429 1C11[PD-1]_H3.181_L3_scFv(GKPGS)4 (SEQ ID NO: 504)
QIQLVQSGSELKKPGASVKVSCKASGYTFTHYGINWVRQAPGQGLEWMGWINTYTGEPTYADGFTGRFVFSIDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024430 1C11[PD-1]_H3.182_L3_scFv(GKPGS)4 (SEQ ID NO: 505)
QIQLVQSGSELVKPGESVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024431 1C11[PD-1]_H3.183_L3_scFv(GKPGS)4 (SEQ ID NO: 506)
QIQLVQSGSVLKKPGESVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024432 1C11[PD-1]_H3.184_L3_scFv(GKPGS)4 (SEQ ID NO: 507)
QIQLVQSGSVLVKPGESVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024433 1C11[PD-1]_H3.185_L3_scFv(GKPGS)4 (SEQ ID NO: 508)
EVQLVQSGSELVKPGESVKVSCKASGYTFTHYGINWVRQPPGQGLEWIGWINTYTGEPYYAPKFTERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024434 1C11[PD-1]_H3.186_L3_scFv(GKPGS)4 (SEQ ID NO: 509)
EVQLVQSGSELVKPGESVKVSCKASGYTFTHYGINWVRQPPGQGLEWMGWINTYTGEPYYAPGFTERFVFSLDTS
VDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024435 1C11[PD-1]_H3.187_L3_scFv(GKPGS)4 (SEQ ID NO: 510)
QVQLVQSGSELVKPGESVKVSCKASGYTFTHYGINWVRQPPGQGLEWMGWINTYTGEPYYAPGFTERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024436 1C11[PD-1]_H3.188_L3_scFv(GKPGS)4 (SEQ ID NO: 511)
QVQLVQSGSELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024437 1C11[PD-1]_H3.189_L3_scFv(GKPGS)4 (SEQ ID NO: 512)
QVQLVQSGSELKKPGASVKVSCKASGYTFTHYGINWVRQPPGQGLEWIGWINTYTGEPYYAPKFTGRFVFSLDTS
VSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93K

>XENP024438 1C11[PD-1]_H3.190_L3_scFv(GKPGS)4 (SEQ ID NO: 513)
QVQLVQSGSVLKKPGGSVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024439 1C11[PD-1]_H3.191_L3_scFv(GKPGS)4 (SEQ ID NO: 514)
QVQLVQSGSELVKPGESVKVSCKASGYTFTHYGMNWVRQAPGQGLEWMGWINTYTGEPTYAPGFTGRFVFSLDTS
QSTAYLQINSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024440 1C11[PD-1]_H3.192_L3_scFv(GKPGS)4 (SEQ ID NO: 515)
EVQLVQSGSVLKKPGESVKVSCKASGYTFTHYGINWVRQAPGQGLEWMGWINTYTGEPTYADGFTERFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024441 1C11[PD-1]_H3.193_L3_scFv(GKPGS)4 (SEQ ID NO: 516)
QIQLVQSGSELKKPGASVKVSCKASGYTFTHYGMNWVRQPPGQGLEWIGWINTYTGEPTYAPGFTERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024442 1C11[PD-1]_H3.194_L3_scFv(GKPGS)4 (SEQ ID NO: 517)
EIQLVQSGSVLKKPGASVKVSCKASGYTFTHYGINWVRQAPGQGLEWIGWINTYTGEPTYADGFTGRFVFSLDTS
VSTAYLQISSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024443 1C11[PD-1]_H3.195_L3_scFv(GKPGS)4 (SEQ ID NO: 518)
QIQLVQSGSELKKPGASVKVSCKASGYTFTHYGMNWVRQPPGQGLEWMGWINTYTGEPYYADGFTGRFVFSLDTS
VDTAYLQINSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024827 1C11_H3.196_L3_scFv(GKPGS)4 (SEQ ID NO: 519)
EVQLVQSGSELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024828 1C11_H3.197_L3_scFv(GKPGS)4 (SEQ ID NO: 520)
QVQLVQSGSELKKPGASVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024829 1C11_H3.198_L3_scFv(GKPGS)4 (SEQ ID NO: 521)
QVQLVQSGSELKKPGESVKVSCKASGYTFTHYGINWVRQPPGQGLEWIGWINTYTGEPYYADGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93L

>XENP024830 1C11_H3.199_L3_scFv(GKPGS)4 (SEQ ID NO: 522)
QVQLVQSGSELKKPGESVKVSCKASGYTFTHYGMNWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024831 1C11_H3.200_L3_scFv(GKPGS)4 (SEQ ID NO: 523)
QVQLVQSGSELKKPGESVKVSCKASGYTFTHYGINWVRQPPGQGLEWIGWINTYTGEPYYAPGFTGRFVFSLDTS
QSTAYLQINSLKAEDTAVYFCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024832 1C11_H3.201_L3_scFv(GKPGS)4 (SEQ ID NO: 524)
QVQLVQSGSELKKPGESVKVSCKASGYTFTHYGINWVRQPPGQGLEWIGWINTYTGEPYYAPGFTGRFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024833 1C11_H3.202_L3_scFv(GKPGS)4 (SEQ ID NO: 525)
QVQLVQSGSELKKPGESVKVSCKASGYTFTHYGINWVRQAPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024834 1C11_H3.203_L3_scFv(GKPGS)4 (SEQ ID NO: 526)
QVQLVQSGSELKKPGESVKVSCKASGYTFTHYGINWVRQPPGQGLEWIGWINTYTGEPYYAPGFTERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024835 1C11_H3.204_L3_scFv(GKPGS)4 (SEQ ID NO: 527)
QVQLVQSGSELKKPGESVKVSCKASGYTFTHYGINWVRQPPGQGLEWIGWINTYTGEPYYAPGFQGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024836 1C11_H3.205_L3_scFv(GKPGS)4 (SEQ ID NO: 528)
QVQLVQSGSELKKPGESVKVSCKASGYTFTHYGINWVRQPPGQGLEWIGWINTYTGEPYYAPGFKGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024837 1C11_H3.206_L3_scFv(GKPGS)4 (SEQ ID NO: 529)
QVQLVQSGSELKKPGESVKVSCKASGYTFTHYGINWVRQPPGQGLEWIGWINTYTGEPTYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024838 1C11_H3.207_L3_scFv(GKPGS)4 (SEQ ID NO: 530)
QVQLVQSGSELKKPGESVKVSCKASGYTFTHYGINWVRQPPGQGLEWIGWINTYTGEPYYAPGFTGRFVFSLDTS
QSTAYLQISSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93M

\>XENP024839 1C11_H3.208_L3_scFv(GKPGS)4 (SEQ ID NO: 531)
QVQLVQSGSELKKPGESVKVSCKASGYTFTHYGINWVRQPPGQGLEWIGWINTYTGEPYYAPGFTGRFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024840 1C11_H3.209_L3_scFv(GKPGS)4 (SEQ ID NO: 532)
QVQLVQSGSELKKPGESVKVSCKASGYTFTHYGINWVRQPPGQGLEWMGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024841 1C11_H3.210_L3_scFv(GKPGS)4 (SEQ ID NO: 533)
QVQLVQSGSELKKPGESVKVSCKASGYTFTHYGINWVRQPPGQGLEWIGWINTYTGEPYYAPGFTGRFVFSLDTS
VSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024842 1C11_H3.211_L3_scFv(GKPGS)4 (SEQ ID NO: 534)
QVQLVQSGPELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024843 1C11_H3.212_L3_scFv(GKPGS)4 (SEQ ID NO: 535)
QVQLVQSGSELKKPGESVKVSCKASGYTFTHYGINWVRQPPGQGLEWIGWINTYTGEPYYAPGFTGRFVFSLDTS
VDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024844 1C11_H3.213_L3_scFv(GKPGS)4 (SEQ ID NO: 536)
QVQLVQSGPELKKPGESVKVSCKASGYTFTHYGINWVRQAPGQGLEWIGWINTYTGEPYYAPGFTGRFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024845 1C11_H3.214_L3_scFv(GKPGS)4 (SEQ ID NO: 537)
QVQLVQSGPELKKPGESVKVSCKASGYTFTHYGINWVRQAPGQGLEWIGWINTYTGEPYYAPGFTGRFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024846 1C11_H3.215_L3_scFv(GKPGS)4 (SEQ ID NO: 538)
QVQLVQSGPELKKPGESVKVSCKASGYTFTHYGINWVRQAPGQGLEWIGWINTYTGEPYYAPGFTGRFVFSLDTS
VSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP024847 1C11_H3.216_L3_scFv(GKPGS)4 (SEQ ID NO: 539)
QVQLVQSGPELKKPGESVKVSCKASGYTFTHYGINWVRQPPGQGLEWMGWINTYTGEPYYAPGFTGRFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93N

>XENP024848 1C11_H3.217_L3_scFv(GKPGS)4 (SEQ ID NO: 540)
QVQLVQSGPELKKPGESVKVSCKASGYTFTHYGINWVRQPPGQGLEWMGWINTYTGEPYYAPGFTGRFVFSLDTS
VSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024849 1C11_H3.218_L3_scFv(GKPGS)4 (SEQ ID NO: 541)
QVQLVQSGPELKKPGESVKVSCKASGYTFTHYGINWVRQPPGQGLEWMGWINTYTGEPYYAPGFTGRFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024850 1C11_H3.219_L3_scFv(GKPGS)4 (SEQ ID NO: 542)
QVQLVQSGSELKKPGESVKVSCKASGYTFTHYGINWVRQPPGQGLEWIGWINTYTGEPYYAPGFQERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024851 1C11_H3.220_L3_scFv(GKPGS)4 (SEQ ID NO: 543)
QVQLVQSGSELKKPGESVKVSCKASGYTFTHYGINWVRQPPGQGLEWIGWINTYTGEPYYAPGFKERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024852 1C11_H3.221_L3_scFv(GKPGS)4 (SEQ ID NO: 544)
EIQLVQSGSELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP024853 1C11[PD-1]_H3_L3.143_scFv(GKPGS)4 (SEQ ID NO: 545)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DVATYYCFQGSHVPNTFGQGTKVEIK

>XENP024854 1C11[PD-1]_H3_L3.144_scFv(GKPGS)4 (SEQ ID NO: 546)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

>XENP024855 1C11[PD-1]_H3_L3.145_scFv(GKPGS)4 (SEQ ID NO: 547)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQSPKLLIYKVSNRFSGVPDRFSGSGSGTDFTLTISSVEAE
DVATYYCFQGSHVPNTFGQGTKVEIK

>XENP024856 1C11[PD-1]_H3_L3.146_scFv(GKPGS)4 (SEQ ID NO: 548)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQSPKLLIYKVSNRFSGVPDRFSGSGSGTDFTLTISSVEAE
DAATYYCFQGSHVPNTFGQGTKVEIK

>XENP024857 1C11[PD-1]_H3_L3.147_scFv(GKPGS)4 (SEQ ID NO: 549)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DVATYYCFQGSHVPNTFGQGTKVEIK

Figure 93O

>XENP024858 1C11[PD-1]_H3_L3.148_scFv(GKPGS)4 (SEQ ID NO: 550)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

>XENP025295 1C11_H3.222_L3_scFv(GKPGS)4 (SEQ ID NO: 551)
QVQLVQSGPELKKPGESVKVSCKASGYTFTHYGINWVRQPPGQGLEWMGWINTYTGEPTYAPGFTGRFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025296 1C11_H3.223_L3_scFv(GKPGS)4 (SEQ ID NO: 552)
QVQLVQSGPELKKPGESVKVSCKASGYTFTHYGINWVRQPPGQGLEWMGWINTYTGEPYYAPGFTERFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025301 1C11_H3.224_L3_scFv(GKPGS)4 (SEQ ID NO: 553)
QVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025302 1C11_H3.225_L3_scFv(GKPGS)4 (SEQ ID NO: 554)
QVQLVQSGPELKKPGESVKVSCKASGYTFTHYGINWVRQAPGQGLEWMGWINTYTGEPYYAPGFTERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025303 1C11_H3.226_L3_scFv(GKPGS)4 (SEQ ID NO: 555)
QVQLVQSGPELKKPGESVKVSCKASGYTFTHYGINWVRQAPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025304 1C11_H3.227_L3_scFv(GKPGS)4 (SEQ ID NO: 556)
EVQLVQSGPELKKPGESVKVSCKASGYTFTHYGINWVRQAPGQGLEWMGWINTYTGEPYYAPGFTERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025305 1C11_H3.228_L3_scFv(GKPGS)4 (SEQ ID NO: 557)
EVQLVQSGPELKKPGESVKVSCKASGYTFTHYGINWVRQAPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

>XENP025306 1C11_H3.229_L3_scFv(GKPGS)4 (SEQ ID NO: 558)
QVQLVQSGSELKKPGESVKVSCKASGYTFTHYGINWVRQPPGQGLEWMGWINTYTGEPYYAPGFQERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93P

\>XENP025307 1C11_H3.230_L3_scFv(GKPGS)4 (SEQ ID NO: 559)
QVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025308 1C11_H3.231_L3_scFv(GKPGS)4 (SEQ ID NO: 560)
QVQLVQSGSELKKPGESVKVSCKASGYTFTHYGINWVRQPPGQGLEWMGWINTYTGEPTYAPGFTGRFVFSLDTS
QSTAYLQISSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025309 1C11_H3.232_L3_scFv(GKPGS)4 (SEQ ID NO: 561)
QVQLVQSGSELKKPGESVKVSCKASGYTFTHYGINWVRQPPGQGLEWMGWINTYTGEPTYAPGFTGRFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025310 1C11_H3.233_L3_scFv(GKPGS)4 (SEQ ID NO: 562)
EVQLVQSGSELKKPGESVKVSCKASGYTFTHYGINWVRQPPGQGLEWMGWINTYTGEPYYAPGFQERFVFSLDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025311 1C11_H3.234_L3_scFv(GKPGS)4 (SEQ ID NO: 563)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025312 1C11_H3.235_L3_scFv(GKPGS)4 (SEQ ID NO: 564)
EVQLVQSGSELKKPGESVKVSCKASGYTFTHYGINWVRQPPGQGLEWMGWINTYTGEPTYAPGFTGRFVFSLDTS
QSTAYLQISSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025313 1C11_H3.236_L3_scFv(GKPGS)4 (SEQ ID NO: 565)
EVQLVQSGSELKKPGESVKVSCKASGYTFTHYGINWVRQPPGQGLEWMGWINTYTGEPTYAPGFTGRFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025314 1C11_H3.237_L3_scFv(GKPGS)4 (SEQ ID NO: 566)
QVQLVQSGSELKKPGESVKVSCKASGYTFTHYGINWVRQAPGQGLEWMGWINTYTGEPYYAPGFTERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025315 1C11_H3.238_L3_scFv(GKPGS)4 (SEQ ID NO: 567)
QVQLVQSGSELKKPGESVKVSCKASGYTFTHYGINWVRQAPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

Figure 93Q

\>XENP025316 1C11_H3.213_L3.144_scFv(GKPGS)4 (SEQ ID NO: 568)
QVQLVQSGPELKKPGESVKVSCKASGYTFTHYGINWVRQAPGQGLEWIGWINTYTGEPYYAPGFTGRFVFSLDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025317 1C11_H3.213_L3.148_scFv(GKPGS)4 (SEQ ID NO: 569)
QVQLVQSGPELKKPGESVKVSCKASGYTFTHYGINWVRQAPGQGLEWIGWINTYTGEPYYAPGFTGRFVFSLDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

\>XENP025318 1C11_H3.216_L3.144_scFv(GKPGS)4 (SEQ ID NO: 570)
QVQLVQSGPELKKPGESVKVSCKASGYTFTHYGINWVRQPPGQGLEWMGWINTYTGEPYYAPGFTGRFVFSIDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025319 1C11_H3.216_L3.148_scFv(GKPGS)4 (SEQ ID NO: 571)
QVQLVQSGPELKKPGESVKVSCKASGYTFTHYGINWVRQPPGQGLEWMGWINTYTGEPYYAPGFTGRFVFSIDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

\>XENP025320 1C11_H3.188_L3.144_scFv(GKPGS)4 (SEQ ID NO: 572)
QVQLVQSGSELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025321 1C11_H3.188_L3.148_scFv(GKPGS)4 (SEQ ID NO: 573)
QVQLVQSGSELKKPGESVKVSCKASGYTFTHYGINWVRQPPGQGLEWIGWINTYTGEPYYAPGFTGRFVFSLDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

\>XENP025802 1C11[PD-1]_H3.224_L3.144_scFv(GKPGS)4 (SEQ ID NO: 574)
QVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025803 1C11[PD-1]_H3.224_L3.148_scFv(GKPGS)4 (SEQ ID NO: 575)
QVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

\>XENP025804 1C11[PD-1]_H3.228_L3.144_scFv(GKPGS)4 (SEQ ID NO: 576)
EVQLVQSGPELKKPGESVKVSCKASGYTFTHYGINWVRQAPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025805 1C11[PD-1]_H3.228_L3.148_scFv(GKPGS)4 (SEQ ID NO: 577)
EVQLVQSGPELKKPGESVKVSCKASGYTFTHYGINWVRQAPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

Figure 93R

\>XENP025806 1C11[PD-1]_H3.234_L3.144_scFv(GKPGS)4 (SEQ ID NO: 578)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFSGVPDRFSGSGSGTDFTLTISSVEAE
DAATYYCFQGSHVPNTFGQGTKVEIK

\>XENP025807 1C11[PD-1]_H3.234_L3.148_scFv(GKPGS)4 (SEQ ID NO: 579)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQAPKLLIYKVSNRFSGVPDRFSGSGSGTDFTLTISSVEAE
DAATYYCFQGSHVPNTFGQGTKVEIK

\>XENP025808 1C11[PD-1]_H3.239_L3.144_scFv(GKPGS)4 (SEQ ID NO: 580)
EVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025809 1C11[PD-1]_H3.240_L3.144_scFv(GKPGS)4 (SEQ ID NO: 581)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025810 1C11[PD-1]_H3.241_L3.144_scFv(GKPGS)4 (SEQ ID NO: 582)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025811 1C11[PD-1]_H3.239_L3.148_scFv(GKPGS)4 (SEQ ID NO: 583)
EVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025812 1C11[PD-1]_H3.240_L3.148_scFv(GKPGS)4 (SEQ ID NO: 584)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025813 1C11[PD-1]_H3.241_L3.148_scFv(GKPGS)4 (SEQ ID NO: 585)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSLQAE
DVAVYYCFQGSHVPNTFGGGTKVEIK

\>XENP025814 1C11[PD-1]_H3.239_L3.125_scFv(GKPGS)4 (SEQ ID NO: 586)
EVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSVEAE
DVAVYYCFQGSHVPNTFGGGTKVEIK

Figure 93S

\>XENP025815 1C11[PD-1]_H3.240_L3.125_scFv(GKPGS)4 (SEQ ID NO: 587)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSVEAE
DVAVYYCFQGSHVPNTFGGGTKVEIK

\>XENP025816 1C11[PD-1]_H3.241_L3.125_scFv(GKPGS)4 (SEQ ID NO: 588)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DVLMTQSPDSL
AVSLGERATINCKSSQSIVHSNGNTYLEWYQQKPGQSPKLLIYKVSNRFSGVPDRFSGSGSGTDFTLTISSVEAE
DVAVYYCFQGSHVPNTFGGGTKVEIK

\>XENP025817 1C11[PD-1]_H3.239_L3.92_scFv(GKPGS)4 (SEQ ID NO: 589)
EVQLVQSGPELKKPGESVKVSCKASGYTFTHYGINWVRQPPGQGLEWMGWINTYTGEPYYAPGFQERFVFSIDTS
QSTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFTGVPDRFSGSGSGTDFTLTISSLQAE
DVAVYYCFQGSHVPNTFGGGTKVEIK

\>XENP025818 1C11[PD-1]_H3.240_L3.92_scFv(GKPGS)4 (SEQ ID NO: 590)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFTGVPDRFSGSGSGTDFTLTISSLQAE
DVAVYYCFQGSHVPNTFGGGTKVEIK

\>XENP025819 1C11[PD-1]_H3.241_L3.92_scFv(GKPGS)4 (SEQ ID NO: 591)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/GKPGSGKPGSGKPGSGKPGS/DIVMTQSPDSL
AVSLGERVTINCKASQSIVHSNGNTYLEWYQQKPGQPPKLLIYKVSNRFTGVPDRFSGSGSGTDFTLTISSLQAE
DVAVYYCFQGSHVPNTFGGGTKVEIK

Figure 94A

>XENP022553 1C11[PD-1]_H3L3_IgG1_PVA_/S267K (SEQ ID NO: 592)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1053)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP025338 1C11[PD-1]_H3.226_L3.144_IgG1_PVA_/S267K (SEQ ID NO: 593)
Heavy Chain
QVQLVQSGPELKKPGESVKVSCKASGYTFTHYGINWVRQAPGQGLEWMGWINTYTGEPYYAPGFQERFVFSLDTSQDTAYLQ
INSLKAEDTAVYYCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1054)
DIVMTQSPDSLAVSLGERVTINCKASQSIVHSNGNTYLEWYQQKPGQPPKLLIYKVSNRFSGVPDRFSGSGSGTDFTLTISS
VEAEDAATYYCFQGSHVPNTFGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP025339 1C11[PD-1]_H3.226_L3.148_IgG1_PVA_/S267K (SEQ ID NO: 594)
Heavy Chain
QVQLVQSGPELKKPGESVKVSCKASGYTFTHYGINWVRQAPGQGLEWMGWINTYTGEPYYAPGFQERFVFSLDTSQDTAYLQ
INSLKAEDTAVYYCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1055)
DIVMTQSPDSLAVSLGERVTINCKASQSIVHSNGNTYLEWYQQKPGQAPKLLIYKVSNRFSGVPDRFSGSGSGTDFTLTISS
VEAEDAATYYCFQGSHVPNTFGQGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026321 1C11[PD-1]_H3.59_L3.1_IgG1_PVA_/S267K (SEQ ID NO: 595)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1056)
DILMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94B

>XENP026322 1C11[PD-1]_H3.59_L3.38_IgG1_PVA_/S267K (SEQ ID NO: 596)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1057)
DVLMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026323 1C11[PD-1]_H3.59_L3.51_IgG1_PVA_/S267K (SEQ ID NO: 597)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1058)
DVLMTQSPDSLAVSLGERATINCKSSQSIVHSNGNTYLEWYQQKPGQSPKLLIYSVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026324 1C11[PD-1]_H3.59_L3.59_IgG1_PVA_/S267K (SEQ ID NO: 598)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1059)
DVLMTQSPDSLAVSLGERATINCKSSQSIVHSNGNTYLEWYQQKPGQSPKLLIYKVSNRFSGVPDRFSGSGSGTDFTLTISR
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026325 1C11[PD-1]_H3.59_L3.73_IgG1_PVA_/S267K (SEQ ID NO: 599)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1060)
DVLMTQSPDSLAVSLGERATINCKSSQSIVHSNGNTYLEWYQQKPGQSPKLLIYKVSNRFSGVPDRFSGSGSGTDFTLTISS
LQAEDVATYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94C

>XENP026326 1C11[PD-1]_H3.59_L3.125_IgG1_PVA_/S267K (SEQ ID NO: 600)
Heavy Chain
QIQLVQSGSELKKPGASVKVSCKASGYTFT<u>HYGMN</u>WVRQAPGQGLEWMG<u>WINTYTGEPTYADGFTG</u>RFVFSLDTSQSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1061)
DVLMTQSPDSLAVSLGERATINC<u>KSSQSIVHSNGNTYLE</u>WYQQKPGQSPKLLIY<u>KVSNRFS</u>GVPDRFSGSGSGTDFTLTISS
VEAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026327 1C11[PD-1]_H3.135_L3.1_IgG1_PVA_/S267K (SEQ ID NO: 601)
Heavy Chain
QIQLVQSGSELKKPGASVKVSCKASGYTFT<u>HYGMN</u>WVRQAPGQGLEWMG<u>WINTYTSEPTYADGFTG</u>RFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1062)
DILMTQSPDSLAVSLGERATINC<u>KSSQSIVHSNGNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026328 1C11[PD-1]_H3.135_L3.38_IgG1_PVA_/S267K (SEQ ID NO: 602)
Heavy Chain
QIQLVQSGSELKKPGASVKVSCKASGYTFT<u>HYGMN</u>WVRQAPGQGLEWMG<u>WINTYTSEPTYADGFTG</u>RFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1063)
DVLMTQSPDSLAVSLGERATINC<u>KSSQSIVHSNGNNYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026329 1C11[PD-1]_H3.135_L3.51_IgG1_PVA_/S267K (SEQ ID NO: 603)
Heavy Chain
QIQLVQSGSELKKPGASVKVSCKASGYTFT<u>HYGMN</u>WVRQAPGQGLEWMG<u>WINTYTSEPTYADGFTG</u>RFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1064)
DVLMTQSPDSLAVSLGERATINC<u>KSSQSIVHSNGNTYLE</u>WYQQKPGQSPKLLIY<u>SVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94D

>XENP026330 1C11[PD-1]_H3.135_L3.59_IgG1_PVA_/S267K (SEQ ID NO: 604)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1065)
DVLMTQSPDSLAVSLGERATINCKSSQSIVHSNGNTYLEWYQQKPGQSPKLLIYKVSNRFSGVPDRFSGSGSGTDFTLTISR
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026331 1C11[PD-1]_H3.135_L3.73_IgG1_PVA_/S267K (SEQ ID NO: 605)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1066)
DVLMTQSPDSLAVSLGERATINCKSSQSIVHSNGNTYLEWYQQKPGQSPKLLIYKVSNRFSGVPDRFSGSGSGTDFTLTISS
LQAEDVATYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026332 1C11[PD-1]_H3.135_L3.125_IgG1_PVA_/S267K (SEQ ID NO: 606)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1067)
DVLMTQSPDSLAVSLGERATINCKSSQSIVHSNGNTYLEWYQQKPGQSPKLLIYKVSNRFSGVPDRFSGSGSGTDFTLTISS
VEAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026333 1C11[PD-1]_H3.138_L3.1_IgG1_PVA_/S267K (SEQ ID NO: 607)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1068)
DILMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94E

>XENP026334 1C11[PD-1]_H3.138_L3.38_IgG1_PVA_/S267K (SEQ ID NO: 608)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1069)
DVLMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026335 1C11[PD-1]_H3.138_L3.51_IgG1_PVA_/S267K (SEQ ID NO: 609)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1070)
DVLMTQSPDSLAVSLGERATINCKSSQSIVHSNGNTYLEWYQQKPGQSPKLLIYSVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026336 1C11[PD-1]_H3.138_L3.59_IgG1_PVA_/S267K (SEQ ID NO: 610)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1071)
DVLMTQSPDSLAVSLGERATINCKSSQSIVHSNGNTYLEWYQQKPGQSPKLLIYKVSNRFSGVPDRFSGSGSGTDFTLTISR
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026337 1C11[PD-1]_H3.138_L3.73_IgG1_PVA_/S267K (SEQ ID NO: 611)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1072)
DVLMTQSPDSLAVSLGERATINCKSSQSIVHSNGNTYLEWYQQKPGQSPKLLIYKVSNRFSGVPDRFSGSGSGTDFTLTISS
LQAEDVATYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94F

>XENP026338_1C11[PD-1]_H3.138_L3.125_IgG1_PVA_/S267K (SEQ ID NO: 612)
Heavy Chain
QIQLVQSGSELKKPGASVKVSCKASGYTFTHYGMNWVRQAPGQGLEWMGWINTYTGDPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1073)
DVLMTQSPDSLAVSLGERATINCKSSQSIVHSNGNTYLEWYQQKPGQSPKLLIYKVSNRFSGVPDRFSGSGSGTDFTLTISS
VEAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026339_1C11[PD-1]_H3.155_L3.1_IgG1_PVA_/S267K (SEQ ID NO: 613)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1074)
DILMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026340_1C11[PD-1]_H3.155_L3.38_IgG1_PVA_/S267K (SEQ ID NO: 614)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1075)
DVLMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026341_1C11[PD-1]_H3.155_L3.51_IgG1_PVA_/S267K (SEQ ID NO: 615)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1076)
DVLMTQSPDSLAVSLGERATINCKSSQSIVHSNGNTYLEWYQQKPGQSPKLLIYSVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94G

>XENP026342 1C11[PD-1]_H3.155_L3.59_IgG1_PVA_/S267K (SEQ ID NO: 616)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1077)
DVLMTQSPDSLAVSLGERATINCKSSQSIVHSNGNTYLEWYQQKPGQSPKLLIYKVSNRFSGVPDRFSGSGSGTDFTLTISR
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026343 1C11[PD-1]_H3.155_L3.73_IgG1_PVA_/S267K (SEQ ID NO: 617)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1078)
DVLMTQSPDSLAVSLGERATINCKSSQSIVHSNGNTYLEWYQQKPGQSPKLLIYKVSNRFSGVPDRFSGSGSGTDFTLTISS
LQAEDVATYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026344 1C11[PD-1]_H3.155_L3.125_IgG1_PVA_/S267K (SEQ ID NO: 618)
Heavy Chain
QIQLVQSGSELKKPGASVKVSCKASGYTFTHYGMNWVRQAPGQGLEWMGWINTYTGEPTYADGFTGRFVFSLDNSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1079)
DVLMTQSPDSLAVSLGERATINCKSSQSIVHSNGNTYLEWYQQKPGQSPKLLIYKVSNRFSGVPDRFSGSGSGTDFTLTISS
VEAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026917 1C11[PD-1]_H3.244_L3_IgG1_PVA_/S267K (SEQ ID NO: 619)
Heavy Chain
QIQLVQSGSELKKPGASVKVSCKASTYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1080)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94H

>XENP026918 1C11[PD-1]_H3.249_L3_IgG1_PVA_/S267K (SEQ ID NO: 620)
Heavy Chain
QIQLVQSGSELKKPGASVKVSCKASGDTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1081)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026919 1C11[PD-1]_H3.250_L3_IgG1_PVA_/S267K (SEQ ID NO: 621)
Heavy Chain
QIQLVQSGSELKKPGASVKVSCKASGKTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1082)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026920 1C11[PD-1]_H3.256_L3_IgG1_PVA_/S267K (SEQ ID NO: 622)
Heavy Chain
QIQLVQSGSELKKPGASVKVSCKASGYTWTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1083)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026921 1C11[PD-1]_H3.258_L3_IgG1_PVA_/S267K (SEQ ID NO: 623)
Heavy Chain
QIQLVQSGSELKKPGASVKVSCKASGYTFVHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1084)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94I

>XENP026922 1C11[PD-1]_H3.288_L3_IgG1_PVA_/S267K (SEQ ID NO: 624)
Heavy Chain
QIQLVQSGSELKKPGASVKVSCKASGYTFTHYGMNWVRQAPGQGLEWMGWINTHTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1085)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026923 1C11[PD-1]_H3.292_L3_IgG1_PVA_/S267K (SEQ ID NO: 625)
Heavy Chain
QIQLVQSGSELKKPGASVKVSCKASGYTFTHYGMNWVRQAPGQGLEWMGWINTYSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1086)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026924 1C11[PD-1]_H3.303_L3_IgG1_PVA_/S267K (SEQ ID NO: 626)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1087)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026925 1C11[PD-1]_H3_L3.149_IgG1_PVA_/S267K (SEQ ID NO: 627)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1088)
DVLMTQSPDSLAVSLGERATINCKSSQSIVYSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94J

>XENP026926 1C11[PD-1]_H3_L3.152_IgG1_PVA_/S267K (SEQ ID NO: 628)
Heavy Chain
QIQLVQSGSELKKPGASVKVSCKASGYTFT<u>HYGMN</u>WVRQAPGQGLEWMG<u>WINTYTGEPTYADGFT</u>GRFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1089)
DVLMTQSPDSLAVSLGERATINC<u>KSSQSIVFSNGNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026927 1C11[PD-1]_H3_L3.160_IgG1_PVA_/S267K (SEQ ID NO: 629)
Heavy Chain
QIQLVQSGSELKKPGASVKVSCKASGYTFT<u>HYGMN</u>WVRQAPGQGLEWMG<u>WINTYTGEPTYADGFT</u>GRFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1090)
DVLMTQSPDSLAVSLGERATINC<u>KSSQSIVHSHGNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026928 1C11[PD-1]_H3_L3.161_IgG1_PVA_/S267K (SEQ ID NO: 630)
Heavy Chain
QIQLVQSGSELKKPGASVKVSCKASGYTFT<u>HYGMN</u>WVRQAPGQGLEWMG<u>WINTYTGEPTYADGFT</u>GRFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1091)
DVLMTQSPDSLAVSLGERATINC<u>KSSQSIVHSEGNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026929 1C11[PD-1]_H3_L3.166_IgG1_PVA_/S267K (SEQ ID NO: 631)
Heavy Chain
QIQLVQSGSELKKPGASVKVSCKASGYTFT<u>HYGMN</u>WVRQAPGQGLEWMG<u>WINTYTGEPTYADGFT</u>GRFVFSLDTSVSTAYLQ
ISSLKAEDTAVYFCAR<u>DYYGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1092)
DVLMTQSPDSLAVSLGERATINC<u>KSSQSIVHSNSNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94K

>XENP026930 1C11[PD-1]_H3_L3.168_IgG1_PVA_/S267K (SEQ ID NO: 632)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1093)
DVLMTQSPDSLAVSLGERATINCKSSQSIVHSNQNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026931 1C11[PD-1]_H3_L3.180_IgG1_PVA_/S267K (SEQ ID NO: 633)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1094)
DVLMTQSPDSLAVSLGERATINCKSSQSIVHSNGNTYLEWYQQKPGQSPKLLILKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026932 1C11[PD-1]_H3_L3.186_IgG1_PVA_/S267K (SEQ ID NO: 634)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1095)
DVLMTQSPDSLAVSLGERATINCKSSQSIVHSNGNTYLEWYQQKPGQSPKLLIYKVSDRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026933 1C11[PD-1]_H3_L3.191_IgG1_PVA_/S267K (SEQ ID NO: 635)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1096)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCEQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94L

>XENP026934 1C11[PD-1]_H3_L3.194_IgG1_PVA_/S267K (SEQ ID NO: 636)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1097)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQDSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026935 1C11[PD-1]_H3_L3.202_IgG1_PVA_/S267K (SEQ ID NO: 637)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1098)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGAHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026936 1C11[PD-1]_H3_L3.204_IgG1_PVA_/S267K (SEQ ID NO: 638)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1099)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGVHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026937 1C11[PD-1]_H3_L3.207_IgG1_PVA_/S267K (SEQ ID NO: 639)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1100)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSDVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94M

>XENP026938 1C11[PD-1]_H3.308_L3.152_IgG1_PVA_/S267K (SEQ ID NO: 640)
Heavy Chain
QIQLVQSGSELKKPGASVKVSCKASGYTFTHYGMNWVRQAPGQGLEWMGWINTYTSEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1101)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026939 1C11[PD-1]_H3.59_L3.152_IgG1_PVA_/S267K (SEQ ID NO: 641)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1102)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026940 1C11[PD-1]_H3.303_L3.152_IgG1_PVA_/S267K (SEQ ID NO: 642)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1103)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026941 1C11[PD-1]_H3.308_L3.180_IgG1_PVA_/S267K (SEQ ID NO: 643)
Heavy Chain
QIQLVQSGSELKKPGASVKVSCKASGYTFTHYGMNWVRQAPGQGLEWMGWINTYTSEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1104)
DVLMTQSPDSLAVSLGERATINCKSSQSIVHSNGNTYLEWYQQKPGQSPKLLILKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94N

>XENP026942 1C11[PD-1]_H3.59_L3.180_IgG1_PVA_/S267K (SEQ ID NO: 644)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1105)
DVLMTQSPDSLAVSLGERATINCKSSQSIVHSNGNTYLEWYQQKPGQSPKLLILKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026943 1C11[PD-1]_H3.303_L3.180_IgG1_PVA_/S267K (SEQ ID NO: 645)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1106)
DVLMTQSPDSLAVSLGERATINCKSSQSIVHSNGNTYLEWYQQKPGQSPKLLILKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026944 1C11[PD-1]_H3.303_L3.210_IgG1_PVA_/S267K (SEQ ID NO: 646)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1107)
DILMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026945 1C11[PD-1]_H3.308_L3_IgG1_PVA_/S267K (SEQ ID NO: 647)
Heavy Chain
QIQLVQSGSELKKPGASVKVSCKASGYTFTHYGMNWVRQAPGQGLEWMGWINTYTSEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1108)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94O

>XENP026946 1C11[PD-1]_H3.59_L3_IgG1_PVA_/S267K (SEQ ID NO: 648)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1109)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026947 1C11[PD-1]_H3.135_L3_IgG1_PVA_/S267K (SEQ ID NO: 649)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1110)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026949 1C11[PD-1]_H3.308_L3.210_IgG1_PVA_/S267K (SEQ ID NO: 650)
Heavy Chain
QIQLVQSGSELKKPGASVKVSCKASGYTFTHYGMNWVRQAPGQGLEWMGWINTYTSEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1111)
DILMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026950 1C11[PD-1]_H3_L3.210_IgG1_PVA_/S267K (SEQ ID NO: 651)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1112)
DILMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94P

>XENP026951 1C11[PD-1]_H3_L3.1_IgG1_PVA_/S267K (SEQ ID NO: 652)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1113)
DILMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026952 1C11[PD-1]_H3_L3.38_IgG1_PVA_/S267K (SEQ ID NO: 653)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1114)
DVLMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026953 1C11[PD-1]_H3_L3.125_IgG1_PVA_/S267K (SEQ ID NO: 654)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1115)
DVLMTQSPDSLAVSLGERATINCKSSQSIVHSNGNTYLEWYQQKPGQSPKLLIYKVSNRFSGVPDRFSGSGSGTDFTLTISS
VEAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP026954 1C11[PD-1]_H3.308_L3.38_IgG1_PVA_/S267K (SEQ ID NO: 655)
Heavy Chain
QIQLVQSGSELKKPGASVKVSCKASGYTFTHYGMNWVRQAPGQGLEWMGWINTYTSEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1116)
DVLMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94Q

>XENP026955 1C11[PD-1]_H3.59_L3.210_IgG1_PVA_/S267K (SEQ ID NO: 656)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1117)
DILMTQSPDSLAVSLGERATINCKSSQSIVHSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27643 1C11_H3_L3.211_IgG1_PVA_/S267K (SEQ ID NO: 657)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1118)
DVLMTQSPDSLAVSLGERATINCKSSQSIVHSNGNTYLEWYQQKPGQSPELLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27644 1C11_H3_L3.212_IgG1_PVA_/S267K (SEQ ID NO: 658)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1119)
DVLMTQSPDSLAVSLGERATINCKSSQSIVHSNGNTYLEWYQQKPGQSPQLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27645 1C11_H3_L3.213_IgG1_PVA_/S267K (SEQ ID NO: 659)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1120)
DVLMTQSPDSLAVSLGERATINCKSSQSIVHSNGNTYLEWYQQKPGQSPTLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94R

>XENP27646 1C11_H3_L3.214_IgG1_PVA_/S267K (SEQ ID NO: 660)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1121)
DVLMTQSPDSLAVSLGERATINCKSSQSIVISNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27647 1C11_H3_L3.215_IgG1_PVA_/S267K (SEQ ID NO: 661)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1122)
DVLMTQSPDSLAVSLGERATINCKSSQSIVLSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27648 1C11_H3_L3.216_IgG1_PVA_/S267K (SEQ ID NO: 662)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1123)
DVLMTQSPDSLAVSLGERATINCKSSQSIVVSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27649 1C11_H3_L3.217_IgG1_PVA_/S267K (SEQ ID NO: 663)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1124)
DVLMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94S

>XENP27650 1C11_H3_L3.218_IgG1_PVA_/S267K (SEQ ID NO: 664)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1125)
DVLMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27651 1C11_H3_L3.219_IgG1_PVA_/S267K (SEQ ID NO: 665)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1126)
DILMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27652 1C11_H3_L3.220_IgG1_PVA_/S267K (SEQ ID NO: 666)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1127)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27839 1C11_H3.309_L3_IgG1_PVA_/S267K (SEQ ID NO: 667)
Heavy Chain
QIQLVQSESELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1128)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94T

>XENP27840 1C11_H3.310_L3_IgG1_PVA_/S267K (SEQ ID NO: 668)
Heavy Chain
QIQLVQSSSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1129)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27841 1C11_H3.311_L3_IgG1_PVA_/S267K (SEQ ID NO: 669)
Heavy Chain
QIQLVQSVSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1130)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27842 1C11_H3.312_L3_IgG1_PVA_/S267K (SEQ ID NO: 670)
Heavy Chain
QIQLVQSGSELTKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1131)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27843 1C11_H3.313_L3_IgG1_PVA_/S267K (SEQ ID NO: 671)
Heavy Chain
QIQLVQSGSELQKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1132)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94U

>XENP27844 1C11_H3.314_L3_IgG1_PVA_/S267K (SEQ ID NO: 672)
Heavy Chain
QIQLVQSGSELYKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1133)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27845 1C11_H3.315_L3_IgG1_PVA_/S267K (SEQ ID NO: 673)
Heavy Chain
QIQLVQSGSELLKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1134)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27846 1C11_H3.316_L3_IgG1_PVA_/S267K (SEQ ID NO: 674)
Heavy Chain
QIQLVQSGSELKKPGASVSVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1135)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27847 1C11_H3.317_L3_IgG1_PVA_/S267K (SEQ ID NO: 675)
Heavy Chain
QIQLVQSGSELKKPGASVTVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1136)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94V

>XENP27848 1C11_H3.318_L3_IgG1_PVA_/S267K (SEQ ID NO: 676)
Heavy Chain
QIQLVQSGSELVKPGASVTVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1137)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27849 1C11_H3.319_L3_IgG1_PVA_/S267K (SEQ ID NO: 677)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1138)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27850 1C11_H3.320_L3_IgG1_PVA_/S267K (SEQ ID NO: 678)
Heavy Chain
QIQLVQSGSELKKPGASVKVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1139)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27851 1C11_H3.321_L3_IgG1_PVA_/S267K (SEQ ID NO: 679)
Heavy Chain
QIQLVQSGSELKKPGASVKVSCKASGYTFTHYGMNWVRQAPGQGLEWMGWINTYSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1140)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94W

>XENP27852 1C11_H3.322_L3_IgG1_PVA_/S267K (SEQ ID NO: 680)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1141)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27853 1C11_H3.323_L3_IgG1_PVA_/S267K (SEQ ID NO: 681)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1142)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27854 1C11_H3.324_L3_IgG1_PVA_/S267K (SEQ ID NO: 682)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1143)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27855 1C11_H3.325_L3_IgG1_PVA_/S267K (SEQ ID NO: 683)
Heavy Chain
QIQLVQSGSELKKPGASVKVSCKASGYTFTHYGMNWVRQAPGQGLEWMGWINTHSGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1144)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94X

>XENP27856 1C11_H3.326_L3_IgG1_PVA_/S267K (SEQ ID NO: 684)
Heavy Chain
QIQLVQSGSELKKPGASVKVSCKASGYTFTHYGMNWVRQAPGQGLEWMGWINTHSGEPTYADGFTGRFVFSLDTSQSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1145)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27857 1C11_H3.319_L3.152_IgG1_PVA_/S267K (SEQ ID NO: 685)
Heavy Chain
QIQLVQSGSELKKPGASVKVSCKASGYTFTHYGMNWVRQAPGQGLEWMGWINTYTGEPTYADGFTGRFVFSLDTSQSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1146)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27858 1C11_H3.320_L3.152_IgG1_PVA_/S267K (SEQ ID NO: 686)
Heavy Chain
QIQLVQSGSELKKPGASVKVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1147)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27859 1C11_H3.321_L3.152_IgG1_PVA_/S267K (SEQ ID NO: 687)
Heavy Chain
QIQLVQSGSELKKPGASVKVSCKASGYTFTHYGMNWVRQAPGQGLEWMGWINTYSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1148)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94Y

>XENP27860 1C11_H3.322_L3.152_IgG1_PVA_/S267K (SEQ ID NO: 688)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1149)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27861 1C11_H3.323_L3.152_IgG1_PVA_/S267K (SEQ ID NO: 689)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1150)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27862 1C11_H3.324_L3.152_IgG1_PVA_/S267K (SEQ ID NO: 690)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1151)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27863 1C11_H3.325_L3.152_IgG1_PVA_/S267K (SEQ ID NO: 691)
Heavy Chain
QIQLVQSGSELKKPGASVKVSCKASGYTFTHYGMNWVRQAPGQGLEWMGWINTHSGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1152)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94Z

>XENP27864 1C11_H3.326_L3.152_IgG1_PVA_/S267K (SEQ ID NO: 692)
Heavy Chain
QIQLVQSGSELKKPGASVKVSCKASGYTFT<u>HYGMN</u>WVRQAPGQGLEWMG<u>WINTHSGEPTYADGFT</u>GRFVFSLDTSQSTAYLQ
ISSLKAEDTAVYFCAR<u>DYFGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1153)
DVLMTQSPDSLAVSLGERATINC<u>KSSQSIVFSNGNTYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27865 1C11_H3.319_L3.220_IgG1_PVA_/S267K (SEQ ID NO: 693)
Heavy Chain
QIQLVQSGSELKKPGASVKVSCKASGYTFT<u>HYGMN</u>WVRQAPGQGLEWMG<u>WINTYTGEPTYADGFT</u>GRFVFSLDTSQSTAYLQ
ISSLKAEDTAVYFCAR<u>DYFGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1154)
DILMTQSPDSLAVSLGERATINC<u>KSSQSIVYSNGNNYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27866 1C11_H3.320_L3.220_IgG1_PVA_/S267K (SEQ ID NO: 694)
Heavy Chain
QIQLVQSGSELKKPGASVKVSCKASGYTFT<u>HYGMN</u>WVRQAPGQGLEWMG<u>WINTHTGEPTYADGFT</u>GRFVFSLDTSVSTAYLQ
ISSLKAEDTAVYFCAR<u>DYFGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1155)
DILMTQSPDSLAVSLGERATINC<u>KSSQSIVYSNGNNYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27867 1C11_H3.321_L3.220_IgG1_PVA_/S267K (SEQ ID NO: 695)
Heavy Chain
QIQLVQSGSELKKPGASVKVSCKASGYTFT<u>HYGMN</u>WVRQAPGQGLEWMG<u>WINTYSGEPTYADGFT</u>GRFVFSLDTSVSTAYLQ
ISSLKAEDTAVYFCAR<u>DYFGSSPY</u>WGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1156)
DILMTQSPDSLAVSLGERATINC<u>KSSQSIVYSNGNNYLE</u>WYQQKPGQSPKLLIY<u>KVSNRFS</u>GVPDRFSGSGSGTDFTLTISS
LQAEDVAVYYC<u>FQGSHVPNT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AA

\>XENP27868 1C11_H3.322_L3.220_IgG1_PVA_/S267K (SEQ ID NO: 696)
Heavy Chain
QIQLVQSGSELKKPGASVKVSCKASGYTFTHYGMNWVRQAPGQGLEWMGWINTYTSEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1157)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP27869 1C11_H3.323_L3.220_IgG1_PVA_/S267K (SEQ ID NO: 697)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1158)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP27870 1C11_H3.324_L3.220_IgG1_PVA_/S267K (SEQ ID NO: 698)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1159)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP27871 1C11_H3.325_L3.220_IgG1_PVA_/S267K (SEQ ID NO: 699)
Heavy Chain
QIQLVQSGSELKKPGASVKVSCKASGYTFTHYGMNWVRQAPGQGLEWMGWINTHSGEPTYADGFTGRFVFSLDTSQSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1160)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AB

>XENP27872 1C11_H3.326_L3.220_IgG1_PVA_/S267K (SEQ ID NO: 700)
Heavy Chain
QIQLVQSGSELKKPGASVKVSCKASGYTFTHYGMNWVRQAPGQGLEWMGWINTHSGEPTYADGFTGRFVFSLDTSQSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1161)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27959 1C11_H3.303_L3.219_IgG1_PVA_/S267K (SEQ ID NO: 701)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1162)
DILMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27960 1C11_H3.303_L3.220_IgG1_PVA_/S267K (SEQ ID NO: 702)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1163)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP27961 1C11_H3.320_L3.219_IgG1_PVA_/S267K (SEQ ID NO: 703)
Heavy Chain
QIQLVQSGSELKKPGASVKVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1164)
DILMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AC

>XENP27962 1C11_H3.323_L3.219_IgG1_PVA_/S267K (SEQ ID NO: 704)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1165)
DILMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP27963 1C11_H3.324_L3.219_IgG1_PVA_/S267K (SEQ ID NO: 705)
Heavy Chain
QIQLVQSGSELKKPGASVKVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1166)
DILMTQSPDSLAVSLGERATINCKSSQSIVFSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP28024 1C11_H3.327_L3.220_IgG1_PVA_/S267K (SEQ ID NO: 706)
Heavy Chain
QIQLVQSGSELLKPGASVKVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1167)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP28025 1C11_H3.328_L3.220_IgG1_PVA_/S267K (SEQ ID NO: 707)
Heavy Chain
QIQLVQSGSELKKPGASVSVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1168)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AD

>XENP28026 1C11_H3.329_L3.220_IgG1_PVA_/S267K (SEQ ID NO: 708)
Heavy Chain
QIQLVQSGSELLKPGASVSVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1169)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28027 1C11_H3.330_L3.220_IgG1_PVA_/S267K (SEQ ID NO: 709)
Heavy Chain
QIQLVQSGSELLKPGASVKVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1170)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28028 1C11_H3.331_L3.220_IgG1_PVA_/S267K (SEQ ID NO: 710)
Heavy Chain
QIQLVQSGSELKKPGASVSVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1171)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28029 1C11_H3.332_L3.220_IgG1_PVA_/S267K (SEQ ID NO: 711)
Heavy Chain
QIQLVQSGSELLKPGASVSVSCKASGYTFTHYGMNWVRQAPGQGLEWMGWINTHSGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1172)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AE

>XENP28030 1C11_H3.333_L3.220_IgG1_PVA_/S267K (SEQ ID NO: 712)
Heavy Chain
QIQLVQSGSELLKPGASVKVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1173)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP28031 1C11_H3.334_L3.220_IgG1_PVA_/S267K (SEQ ID NO: 713)
Heavy Chain
QIQLVQSGSELKKPGASVSVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1174)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP28032 1C11_H3.335_L3.220_IgG1_PVA_/S267K (SEQ ID NO: 714)
Heavy Chain
QIQLVQSGSELLKPGASVSVSCKASGYTFTHYGMNWVRQAPGQGLEWMGWINTHSGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1175)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP28033 1C11_H3.336_L3.220_IgG1_PVA_/S267K (SEQ ID NO: 715)
Heavy Chain
QIQLVQSGSELLKPGASVKVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1176)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AF

\>XENP28034 1C11_H3.337_L3.220_IgG1_PVA_/S267K (SEQ ID NO: 716)
Heavy Chain
QIQLVQSGSELKKPGASVSVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1177)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP28035 1C11_H3.338_L3.220_IgG1_PVA_/S267K (SEQ ID NO: 717)
Heavy Chain
QIQLVQSGSELLKPGASVSVSCKASGYTFTHYGMNWVRQAPGQGLEWMGWINTYTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1178)
DILMTQSPDSLAVSLGERATINCKSSQSIVYSNGNNYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP28651 1C11_H3.327_L3.152_IgG1_PVA_/S267K (SEQ ID NO: 718)
Heavy Chain
QIQLVQSGSELLKPGASVKVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1179)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP28652 1C11_H3.328_L3.152_IgG1_PVA_/S267K (SEQ ID NO: 719)
Heavy Chain
QIQLVQSGSELKKPGASVSVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1180)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AG

>XENP28653 1C11_H3.329_L3.152_IgG1_PVA_/S267K (SEQ ID NO: 720)
Heavy Chain
QIQLVQSGSELLKPGASVSVSCKASGYTFTHYGMNWVRQAPGQGLEWMGWINTHTGEPTYADGFTGRFVFSLDTSVSTAYLQ
ISSLKAEDTAVYFCARDYFGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1181)
DVLMTQSPDSLAVSLGERATINCKSSQSIVFSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28654 1C11_H3.23_L3_IgG1_PVA_/S267K (SEQ ID NO: 721)
Heavy Chain
QIQLVQSGSELKKPGASVKVSCKASGYTFTHYGMNWVRQAPGQGLEWMGYINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1182)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28655 1C11_H3.28_L3_IgG1_PVA_/S267K (SEQ ID NO: 722)
Heavy Chain
QIQLVQSGSELKKPGASVKVSCKASGYTFTHYGMNWVRQAPGQGLEWMGWINTYTGETTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1183)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP28656 1C11_H3.35_L3_IgG1_PVA_/S267K (SEQ ID NO: 723)
Heavy Chain
QIQLVQSGSELKKPGASVKVSCKASGYTFTHYGMNWVRQAPGQGLEWMGWINTYTGEPTYADKFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1184)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AH

\>XENP28657 1C11_H3_L3.71_IgG1_PVA_/S267K (SEQ ID NO: 724)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1185)
DVLMTQSPDSLAVSLGERATINCKSSQSIVHSNGNTYLEWYQQKPGQSPKLLIYKVSNRFSGVPDRFSGSGSGTDFTLTISS
LQAEDIAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP28658 1C11_H3_L3.74_IgG1_PVA_/S267K (SEQ ID NO: 725)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1186)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCQQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP28659 1C11_H3_L3.77_IgG1_PVA_/S267K (SEQ ID NO: 726)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1187)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQYSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC \>XENP29029 1C11_H3.246_L3_IgG1_PVA_/S267K (SEQ ID NO: 727)
Heavy Chain
QIQLVQSGSELKKPGASVKVSCKASGLTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1188)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AI

>XENP29030 1C11_H3.247_L3_IgG1_PVA_/S267K (SEQ ID NO: 728)
Heavy Chain
QIQLVQSGSELKKPGASVKVSCKASGHTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK Light Chain (SEQ ID NO:1189)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29031 1C11_H3.248_L3_IgG1_PVA_/S267K (SEQ ID NO: 729)
Heavy Chain
QIQLVQSGSELKKPGASVKVSCKASGQTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK Light Chain (SEQ ID NO:1190)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29032 1C11_H3.254_L3_IgG1_PVA_/S267K (SEQ ID NO: 730)
Heavy Chain
QIQLVQSGSELKKPGASVKVSCKASGYQFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK Light Chain (SEQ ID NO:1191)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29033 1C11_H3.263_L3_IgG1_PVA_/S267K (SEQ ID NO: 731)
Heavy Chain
QIQLVQSGSELKKPGASVKVSCKASGYTFTQYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK Light Chain (SEQ ID NO:1192)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AJ

>XENP29034 1C11_H3.264_L3_IgG1_PVA_/S267K (SEQ ID NO: 732)
Heavy Chain
QIQLVQSGSELKKPGASVKVSCKASGYTFTDYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1193)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29035 1C11_H3.265_L3_IgG1_PVA_/S267K (SEQ ID NO: 733)
Heavy Chain
QIQLVQSGSELKKPGASVKVSCKASGYTFTRYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1194)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29036 1C11_H3.269_L3_IgG1_PVA_/S267K (SEQ ID NO: 734)
Heavy Chain
QIQLVQSGSELKKPGASVKVSCKASGYTFTHLGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1195)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29037 1C11_H3.276_L3_IgG1_PVA_/S267K (SEQ ID NO: 735)
Heavy Chain
QIQLVQSGSELKKPGASVKVSCKASGYTFTHYGMNWFRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1196)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AK

>XENP29038 1C11_H3.283_L3_IgG1_PVA_/S267K (SEQ ID NO: 736)
Heavy Chain
QIQLVQSGSELKKPGASVKVSCKASGYTFTHYGMNWVRQAPGQGLEWMGWIQTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1197)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29039 1C11_H3.284_L3_IgG1_PVA_/S267K (SEQ ID NO: 737)
Heavy Chain
QIQLVQSGSELKKPGASVKVSCKASGYTFTHYGMNWVRQAPGQGLEWMGWIETYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1198)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29040 1C11_H3.285_L3_IgG1_PVA_/S267K (SEQ ID NO: 738)
Heavy Chain
QIQLVQSGSELKKPGASVKVSCKASGYTFTHYGMNWVRQAPGQGLEWMGWIHTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1199)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP29041 1C11_H3.286_L3_IgG1_PVA_/S267K (SEQ ID NO: 739)
Heavy Chain
QIQLVQSGSELKKPGASVKVSCKASGYTFTHYGMNWVRQAPGQGLEWMGWISTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1200)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AL

>XENP29042 1C11_H3.289_L3_IgG1_PVA_/S267K (SEQ ID NO: 740)
Heavy Chain
QIQLVQSGSELKKPGASVKVSCKASGYTFTHYGMNWVRQAPGQGLEWMGWINTLTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1201)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29043 1C11_H3.290_L3_IgG1_PVA_/S267K (SEQ ID NO: 741)
Heavy Chain
QIQLVQSGSELKKPGASVKVSCKASGYTFTHYGMNWVRQAPGQGLEWMGWINTWTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1202)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29044 1C11_H3.294_L3_IgG1_PVA_/S267K (SEQ ID NO: 742)
Heavy Chain
QIQLVQSGSELKKPGASVKVSCKASGYTFTHYGMNWVRQAPGQGLEWMGWINTYIGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1203)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29045 1C11_H3.296_L3_IgG1_PVA_/S267K (SEQ ID NO: 743)
Heavy Chain
QIQLVQSGSELKKPGASVKVSCKASGYTFTHYGMNWVRQAPGQGLEWMGWINTYTGKPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1204)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AM

>XENP29046 1C11_H3_L3.155_IgG1_PVA_/S267K (SEQ ID NO: 744)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1205)
DVLMTQSPDSLAVSLGERATINCKSSQSIVHTNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29047 1C11_H3_L3.157_IgG1_PVA_/S267K (SEQ ID NO: 745)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1206)
DVLMTQSPDSLAVSLGERATINCKSSQSIVHQNGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29048 1C11_H3_L3.163_IgG1_PVA_/S267K (SEQ ID NO: 746)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1207)
DVLMTQSPDSLAVSLGERATINCKSSQSIVHSPGNTYLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29049 1C11_H3_L3.173_IgG1_PVA_/S267K (SEQ ID NO: 747)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1208)
DVLMTQSPDSLAVSLGERATINCKSSQSIVHSNGNTFLEWYQQKPGQSPKLLIYKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AN

>XENP29050 1C11_H3_L3.181_IgG1_PVA_/S267K (SEQ ID NO: 748)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1209)
DVLMTQSPDSLAVSLGERATINCKSSQSIVHSNGNTYLEWYQQKPGQSPKLLIWKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29051 1C11_H3_L3.182_IgG1_PVA_/S267K (SEQ ID NO: 749)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1210)
DVLMTQSPDSLAVSLGERATINCKSSQSIVHSNGNTYLEWYQQKPGQSPKLLIQKVSNRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29052 1C11_H3_L3.189_IgG1_PVA_/S267K (SEQ ID NO: 750)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1211)
DVLMTQSPDSLAVSLGERATINCKSSQSIVHSNGNTYLEWYQQKPGQSPKLLIYKVSRRFSGVPDRFSGSGSGTDFTLTISS
LQAEDVAVYYCFQGSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29053 1C11_H3_L3.192_IgG1_PVA_/S267K (SEQ ID NO: 751)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1212)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQASHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 94AO

>XENP29054 1C11_H3_L3.193_IgG1_PVA_/S267K (SEQ ID NO: 752)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1213)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQSSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29055 1C11_H3_L3.196_IgG1_PVA_/S267K (SEQ ID NO: 753)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1214)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQQSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP29056 1C11_H3_L3.198_IgG1_PVA_/S267K (SEQ ID NO: 754)
Heavy Chain
QIQLVQSGSELKKPGASVKVSCKASGYTFTHYGMNWVRQAPGQGLEWMGWINTYTGEPTYADGFTGRFVFSLDTSVSTAYLQ
ISSLKAEDTAVYFCARDYYGSSPYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPK
PKDTLMISRTPEVTCVVVDVKHEDPEVKFNWYVDGVEVHNAKTKPREEQYNSTYRVVSVLTVLHQDWLNGKEYKCKVSNKAL
PAPIEKTISKAKGQPREPQVYTLPPSREEMTKNQVSLTCLVKGFYPSDIAVEWESNGQPENNYKTTPPVLDSDGSFFLYSKL
TVDKSRWQQGNVFSCSVMHEALHNHYTQKSLSLSPGK

Light Chain (SEQ ID NO:1215)
DVLMTQSPDSLAVSLGERATINCKSSQSIVHSNGNTYLEWYQQKPGQSPKLLIYKVSNRFSGVPDRFSGSGSGTDFTLTISS
LQAEDVAVYYCFQLSHVPNTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 95A

>XenD17478 1C11[PD-1]_H3_IgG1_PVA_/S267K (SEQ ID NO: 755)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD18576 1C11_H3.59_IgG1_PVA_/S267K (SEQ ID NO: 756)
QIQLVQSGSELKKPGASVKVSCKASGYTFTHYGMNWVRQAPGQGLEWMGWINTYTGEPTYADGFTGRFVFSLDTS
QSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22097 1C11_H3.242_IgG1_PVA_/S267K (SEQ ID NO: 757)
QIQLVQSGSELKKPGASVKVSCKASAYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22098 1C11_H3.243_IgG1_PVA_/S267K (SEQ ID NO: 758)
QIQLVQSGSELKKPGASVKVSCKASSYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22099 1C11_H3.244_IgG1_PVA_/S267K (SEQ ID NO: 759)
QIQLVQSGSELKKPGASVKVSCKASTYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22100 1C11_H3.245_IgG1_PVA_/S267K (SEQ ID NO: 760)
QIQLVQSGSELKKPGASVKVSCKASGWTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22101 1C11_H3.246_IgG1_PVA_/S267K (SEQ ID NO: 761)
QIQLVQSGSELKKPGASVKVSCKASGLTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95B

\>XenD22102 1C11_H3.247_IgG1_PVA_/S267K (SEQ ID NO: 762)
QIQLVQSGSELKKPGASVKVSCKASGHTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22103 1C11_H3.248_IgG1_PVA_/S267K (SEQ ID NO: 763)
QIQLVQSGSELKKPGASVKVSCKASGQTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22104 1C11_H3.249_IgG1_PVA_/S267K (SEQ ID NO: 764)
QIQLVQSGSELKKPGASVKVSCKASGDTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22105 1C11_H3.250_IgG1_PVA_/S267K (SEQ ID NO: 765)
QIQLVQSGSELKKPGASVKVSCKASGKTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22106 1C11_H3.251_IgG1_PVA_/S267K (SEQ ID NO: 766)
QIQLVQSGSELKKPGASVKVSCKASGYVFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22107 1C11_H3.252_IgG1_PVA_/S267K (SEQ ID NO: 767)
QIQLVQSGSELKKPGASVKVSCKASGYAFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22108 1C11_H3.253_IgG1_PVA_/S267K (SEQ ID NO: 768)
QIQLVQSGSELKKPGASVKVSCKASGYIFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95C

\>XenD22109 1C11_H3.254_IgG1_PVA_/S267K (SEQ ID NO: 769)
QIQLVQSGSELKKPGASVKVSCKASGYQFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22110 1C11_H3.255_IgG1_PVA_/S267K (SEQ ID NO: 770)
QIQLVQSGSELKKPGASVKVSCKASGYTYTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22111 1C11_H3.256_IgG1_PVA_/S267K (SEQ ID NO: 771)
QIQLVQSGSELKKPGASVKVSCKASGYTWTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22112 1C11_H3.257_IgG1_PVA_/S267K (SEQ ID NO: 772)
QIQLVQSGSELKKPGASVKVSCKASGYTHTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22113 1C11_H3.258_IgG1_PVA_/S267K (SEQ ID NO: 773)
QIQLVQSGSELKKPGASVKVSCKASGYTFVHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22114 1C11_H3.259_IgG1_PVA_/S267K (SEQ ID NO: 774)
QIQLVQSGSELKKPGASVKVSCKASGYTFAHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22115 1C11_H3.260_IgG1_PVA_/S267K (SEQ ID NO: 775)
QIQLVQSGSELKKPGASVKVSCKASGYTFIHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95D

\>XenD22116 1C11_H3.261_IgG1_PVA_/S267K (SEQ ID NO: 776)
QIQLVQSGSELKKPGASVKVSCKASGYTFQHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22117 1C11_H3.262_IgG1_PVA_/S267K (SEQ ID NO: 777)
QIQLVQSGSELKKPGASVKVSCKASGYTFTYYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22118 1C11_H3.263_IgG1_PVA_/S267K (SEQ ID NO: 778)
QIQLVQSGSELKKPGASVKVSCKASGYTFTQYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22119 1C11_H3.264_IgG1_PVA_/S267K (SEQ ID NO: 779)
QIQLVQSGSELKKPGASVKVSCKASGYTFTDYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22120 1C11_H3.265_IgG1_PVA_/S267K (SEQ ID NO: 780)
QIQLVQSGSELKKPGASVKVSCKASGYTFTRYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22121 1C11_H3.266_IgG1_PVA_/S267K (SEQ ID NO: 781)
QIQLVQSGSELKKPGASVKVSCKASGYTFTFYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22122 1C11_H3.267_IgG1_PVA_/S267K (SEQ ID NO: 782)
QIQLVQSGSELKKPGASVKVSCKASGYTFTHFGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95E

>XenD22123 1C11_H3.268_IgG1_PVA_/S267K (SEQ ID NO: 783)
QIQLVQSGSELKKPGASVKVSCKASGYTFTHHGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22124 1C11_H3.269_IgG1_PVA_/S267K (SEQ ID NO: 784)
QIQLVQSGSELKKPGASVKVSCKASGYTFTHLGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22125 1C11_H3.270_IgG1_PVA_/S267K (SEQ ID NO: 785)
QIQLVQSGSELKKPGASVKVSCKASGYTFTHWGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22126 1C11_H3.271_IgG1_PVA_/S267K (SEQ ID NO: 786)
QIQLVQSGSELKKPGASVKVSCKASGYTFTHYTMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22127 1C11_H3.272_IgG1_PVA_/S267K (SEQ ID NO: 787)
QIQLVQSGSELKKPGASVKVSCKASGYTFTHYQMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22128 1C11_H3.273_IgG1_PVA_/S267K (SEQ ID NO: 788)
QIQLVQSGSELKKPGASVKVSCKASGYTFTHYGLNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22129 1C11_H3.274_IgG1_PVA_/S267K (SEQ ID NO: 789)
QIQLVQSGSELKKPGASVKVSCKASGYTFTHYGMNWLRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95F

>XenD22130 1C11_H3.275_IgG1_PVA_/S267K (SEQ ID NO: 790)
QIQLVQSGSELKKPGASVKVSCKASGYTFTHYGMNWTRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22131 1C11_H3.276_IgG1_PVA_/S267K (SEQ ID NO: 791)
QIQLVQSGSELKKPGASVKVSCKASGYTFTHYGMNWFRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22132 1C11_H3.277_IgG1_PVA_/S267K (SEQ ID NO: 792)
QIQLVQSGSELKKPGASVKVSCKASGYTFTHYGMNWVRQAPGQGLEWMTWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22133 1C11_H3.278_IgG1_PVA_/S267K (SEQ ID NO: 793)
QIQLVQSGSELKKPGASVKVSCKASGYTFTHYGMNWVRQAPGQGLEWMDWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22134 1C11_H3.279_IgG1_PVA_/S267K (SEQ ID NO: 794)
QIQLVQSGSELKKPGASVKVSCKASGYTFTHYGMNWVRQAPGQGLEWMQWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22135 1C11_H3.280_IgG1_PVA_/S267K (SEQ ID NO: 795)
QIQLVQSGSELKKPGASVKVSCKASGYTFTHYGMNWVRQAPGQGLEWMEWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22136 1C11_H3.281_IgG1_PVA_/S267K (SEQ ID NO: 796)
QIQLVQSGSELKKPGASVKVSCKASGYTFTHYGMNWVRQAPGQGLEWMGFINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95G

>XenD22137 1C11_H3.282_IgG1_PVA_/S267K (SEQ ID NO: 797)
QIQLVQSGSELKKPGASVKVSCKASGYTFTHYGMNWVRQAPGQGLEWMGHINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22138 1C11_H3.283_IgG1_PVA_/S267K (SEQ ID NO: 798)
QIQLVQSGSELKKPGASVKVSCKASGYTFTHYGMNWVRQAPGQGLEWMGWIQTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22139 1C11_H3.284_IgG1_PVA_/S267K (SEQ ID NO: 799)
QIQLVQSGSELKKPGASVKVSCKASGYTFTHYGMNWVRQAPGQGLEWMGWIETYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22140 1C11_H3.285_IgG1_PVA_/S267K (SEQ ID NO: 800)
QIQLVQSGSELKKPGASVKVSCKASGYTFTHYGMNWVRQAPGQGLEWMGWIHTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22141 1C11_H3.286_IgG1_PVA_/S267K (SEQ ID NO: 801)
QIQLVQSGSELKKPGASVKVSCKASGYTFTHYGMNWVRQAPGQGLEWMGWISTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22142 1C11_H3.287_IgG1_PVA_/S267K (SEQ ID NO: 802)
QIQLVQSGSELKKPGASVKVSCKASGYTFTHYGMNWVRQAPGQGLEWMGWINTFTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22143 1C11_H3.288_IgG1_PVA_/S267K (SEQ ID NO: 803)
QIQLVQSGSELKKPGASVKVSCKASGYTFTHYGMNWVRQAPGQGLEWMGWINTHTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95H

>XenD22144 1C11_H3.289_IgG1_PVA_/S267K (SEQ ID NO: 804)
QIQLVQSGSELKKPGASVKVSCKASGYTFTHYGMNWVRQAPGQGLEWMGWINTLTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22145 1C11_H3.290_IgG1_PVA_/S267K (SEQ ID NO: 805)
QIQLVQSGSELKKPGASVKVSCKASGYTFTHYGMNWVRQAPGQGLEWMGWINTWTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22146 1C11_H3.291_IgG1_PVA_/S267K (SEQ ID NO: 806)
QIQLVQSGSELKKPGASVKVSCKASGYTFTHYGMNWVRQAPGQGLEWMGWINTYVGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22147 1C11_H3.292_IgG1_PVA_/S267K (SEQ ID NO: 807)
QIQLVQSGSELKKPGASVKVSCKASGYTFTHYGMNWVRQAPGQGLEWMGWINTYSGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22148 1C11_H3.293_IgG1_PVA_/S267K (SEQ ID NO: 808)
QIQLVQSGSELKKPGASVKVSCKASGYTFTHYGMNWVRQAPGQGLEWMGWINTYAGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22149 1C11_H3.294_IgG1_PVA_/S267K (SEQ ID NO: 809)
QIQLVQSGSELKKPGASVKVSCKASGYTFTHYGMNWVRQAPGQGLEWMGWINTYIGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22150 1C11_H3.295_IgG1_PVA_/S267K (SEQ ID NO: 810)
QIQLVQSGSELKKPGASVKVSCKASGYTFTHYGMNWVRQAPGQGLEWMGWINTYTGQPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95I

\>XenD22151 1C11_H3.296_IgG1_PVA_/S267K (SEQ ID NO: 811)
QIQLVQSGSELKKPGASVKVSCKASGYTFTHYGMNWVRQAPGQGLEWMGWINTYTGKPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22152 1C11_H3.297_IgG1_PVA_/S267K (SEQ ID NO: 812)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDFYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22153 1C11_H3.298_IgG1_PVA_/S267K (SEQ ID NO: 813)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDQYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22154 1C11_H3.299_IgG1_PVA_/S267K (SEQ ID NO: 814)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDHYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22155 1C11_H3.300_IgG1_PVA_/S267K (SEQ ID NO: 815)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDRYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22156 1C11_H3.301_IgG1_PVA_/S267K (SEQ ID NO: 816)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDKYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

\>XenD22157 1C11_H3.302_IgG1_PVA_/S267K (SEQ ID NO: 817)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYWGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 95J

>XenD22158 1C11_H3.303_IgG1_PVA_/S267K (SEQ ID NO: 818)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22159 1C11_H3.304_IgG1_PVA_/S267K (SEQ ID NO: 819)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYASSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22160 1C11_H3.305_IgG1_PVA_/S267K (SEQ ID NO: 820)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYSSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22161 1C11_H3.306_IgG1_PVA_/S267K (SEQ ID NO: 821)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPFWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XenD22162 1C11_H3.307_IgG1_PVA_/S267K (SEQ ID NO: 822)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPWWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

Figure 96A

>XenD17482 1C11[PD-1]_L3 (SEQ ID NO: 823)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD18472 1C11_L3.38 (SEQ ID NO: 824)
DVLMTQSPDSLAVSLGERATINCKSSQSIVHSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22163 1C11[PD-1]_L3.149 (SEQ ID NO: 825)
DVLMTQSPDSLAVSLGERATINCKSSQSIVYSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22164 1C11[PD-1]_L3.150 (SEQ ID NO: 826)
DVLMTQSPDSLAVSLGERATINCKSSQSIVQSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22165 1C11[PD-1]_L3.151 (SEQ ID NO: 827)
DVLMTQSPDSLAVSLGERATINCKSSQSIVDSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22166 1C11[PD-1]_L3.152 (SEQ ID NO: 828)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22167 1C11[PD-1]_L3.153 (SEQ ID NO: 829)
DVLMTQSPDSLAVSLGERATINCKSSQSIVTSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22168 1C11[PD-1]_L3.154 (SEQ ID NO: 830)
DVLMTQSPDSLAVSLGERATINCKSSQSIVKSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22169 1C11[PD-1]_L3.155 (SEQ ID NO: 831)
DVLMTQSPDSLAVSLGERATINCKSSQSIVHTNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22170 1C11[PD-1]_L3.156 (SEQ ID NO: 832)
DVLMTQSPDSLAVSLGERATINCKSSQSIVHANGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22171 1C11[PD-1]_L3.157 (SEQ ID NO: 833)
DVLMTQSPDSLAVSLGERATINCKSSQSIVHQNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 96B

\>XenD22172 1C11[PD-1]_L3.158 (SEQ ID NO: 834)
DVLMTQSPDSLAVSLGERATINCKSSQSIVHGNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22173 1C11[PD-1]_L3.159 (SEQ ID NO: 835)
DVLMTQSPDSLAVSLGERATINCKSSQSIVHVNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22174 1C11[PD-1]_L3.160 (SEQ ID NO: 836)
DVLMTQSPDSLAVSLGERATINCKSSQSIVHSHGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22175 1C11[PD-1]_L3.161 (SEQ ID NO: 837)
DVLMTQSPDSLAVSLGERATINCKSSQSIVHSEGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22176 1C11[PD-1]_L3.162 (SEQ ID NO: 838)
DVLMTQSPDSLAVSLGERATINCKSSQSIVHSSGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22177 1C11[PD-1]_L3.163 (SEQ ID NO: 839)
DVLMTQSPDSLAVSLGERATINCKSSQSIVHSRGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22178 1C11[PD-1]_L3.164 (SEQ ID NO: 840)
DVLMTQSPDSLAVSLGERATINCKSSQSIVHSLGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22179 1C11[PD-1]_L3.165 (SEQ ID NO: 841)
DVLMTQSPDSLAVSLGERATINCKSSQSIVHSNANTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22180 1C11[PD-1]_L3.166 (SEQ ID NO: 842)
DVLMTQSPDSLAVSLGERATINCKSSQSIVHSNSNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22181 1C11[PD-1]_L3.167 (SEQ ID NO: 843)
DVLMTQSPDSLAVSLGERATINCKSSQSIVHSNTNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

\>XenD22182 1C11[PD-1]_L3.168 (SEQ ID NO: 844)
DVLMTQSPDSLAVSLGERATINCKSSQSIVHSNQNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 96C

>XenD22183 1C11[PD-1]_L3.169 (SEQ ID NO: 845)
DVLMTQSPDSLAVSLGERATINCKSSQSIVHSNGDTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22184 1C11[PD-1]_L3.170 (SEQ ID NO: 846)
DVLMTQSPDSLAVSLGERATINCKSSQSIVHSNGHTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22185 1C11[PD-1]_L3.171 (SEQ ID NO: 847)
DVLMTQSPDSLAVSLGERATINCKSSQSIVHSNGETYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22186 1C11[PD-1]_L3.172 (SEQ ID NO: 848)
DVLMTQSPDSLAVSLGERATINCKSSQSIVHSNGRTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22187 1C11[PD-1]_L3.173 (SEQ ID NO: 849)
DVLMTQSPDSLAVSLGERATINCKSSQSIVHSNGNTFLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22188 1C11[PD-1]_L3.174 (SEQ ID NO: 850)
DVLMTQSPDSLAVSLGERATINCKSSQSIVHSNGNTHLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22189 1C11[PD-1]_L3.175 (SEQ ID NO: 851)
DVLMTQSPDSLAVSLGERATINCKSSQSIVHSNGNTLLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22190 1C11[PD-1]_L3.176 (SEQ ID NO: 852)
DVLMTQSPDSLAVSLGERATINCKSSQSIVHSNGNTWLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22191 1C11[PD-1]_L3.177 (SEQ ID NO: 853)
DVLMTQSPDSLAVSLGERATINCKSSQSIVHSNGNTQLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22192 1C11[PD-1]_L3.178 (SEQ ID NO: 854)
DVLMTQSPDSLAVSLGERATINCKSSQSIVHSNGNTYLEWYQQKPGQSPKLLIFKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22193 1C11[PD-1]_L3.179 (SEQ ID NO: 855)
DVLMTQSPDSLAVSLGERATINCKSSQSIVHSNGNTYLEWYQQKPGQSPKLLIHKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 96D

>XenD22194 1C11[PD-1]_L3.180 (SEQ ID NO: 856)
DVLMTQSPDSLAVSLGERATINCKSSQSIVHSNGNTYLEWYQQKPGQSPKLLILKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22195 1C11[PD-1]_L3.181 (SEQ ID NO: 857)
DVLMTQSPDSLAVSLGERATINCKSSQSIVHSNGNTYLEWYQQKPGQSPKLLIWKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22196 1C11[PD-1]_L3.182 (SEQ ID NO: 858)
DVLMTQSPDSLAVSLGERATINCKSSQSIVHSNGNTYLEWYQQKPGQSPKLLIQKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22197 1C11[PD-1]_L3.183 (SEQ ID NO: 859)
DVLMTQSPDSLAVSLGERATINCKSSQSIVHSNGNTYLEWYQQKPGQSPKLLIYKISNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22198 1C11[PD-1]_L3.184 (SEQ ID NO: 860)
DVLMTQSPDSLAVSLGERATINCKSSQSIVHSNGNTYLEWYQQKPGQSPKLLIYKLSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22199 1C11[PD-1]_L3.185 (SEQ ID NO: 861)
DVLMTQSPDSLAVSLGERATINCKSSQSIVHSNGNTYLEWYQQKPGQSPKLLIYKSSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22200 1C11[PD-1]_L3.186 (SEQ ID NO: 862)
DVLMTQSPDSLAVSLGERATINCKSSQSIVHSNGNTYLEWYQQKPGQSPKLLIYKVSDRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22201 1C11[PD-1]_L3.187 (SEQ ID NO: 863)
DVLMTQSPDSLAVSLGERATINCKSSQSIVHSNGNTYLEWYQQKPGQSPKLLIYKVSHRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22202 1C11[PD-1]_L3.188 (SEQ ID NO: 864)
DVLMTQSPDSLAVSLGERATINCKSSQSIVHSNGNTYLEWYQQKPGQSPKLLIYKVSERFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22203 1C11[PD-1]_L3.189 (SEQ ID NO: 865)
DVLMTQSPDSLAVSLGERATINCKSSQSIVHSNGNTYLEWYQQKPGQSPKLLIYKVSPRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22204 1C11[PD-1]_L3.190 (SEQ ID NO: 866)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCMQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 96E

>XenD22205 1C11[PD-1]_L3.191 (SEQ ID NO: 867)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCEQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22206 1C11[PD-1]_L3.192 (SEQ ID NO: 868)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQASHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22207 1C11[PD-1]_L3.193 (SEQ ID NO: 869)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQSSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22208 1C11[PD-1]_L3.194 (SEQ ID NO: 870)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQDSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22209 1C11[PD-1]_L3.195 (SEQ ID NO: 871)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQTSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22210 1C11[PD-1]_L3.196 (SEQ ID NO: 872)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQQSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22211 1C11[PD-1]_L3.197 (SEQ ID NO: 873)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQHSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22212 1C11[PD-1]_L3.198 (SEQ ID NO: 874)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQLSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22213 1C11[PD-1]_L3.199 (SEQ ID NO: 875)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQPSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22214 1C11[PD-1]_L3.200 (SEQ ID NO: 876)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQFSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22215 1C11[PD-1]_L3.201 (SEQ ID NO: 877)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGTHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 96F

>XenD22216 1C11[PD-1]_L3.202 (SEQ ID NO: 878)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGAHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22217 1C11[PD-1]_L3.203 (SEQ ID NO: 879)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGQHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22218 1C11[PD-1]_L3.204 (SEQ ID NO: 880)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGVHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22219 1C11[PD-1]_L3.205 (SEQ ID NO: 881)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSYVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22220 1C11[PD-1]_L3.206 (SEQ ID NO: 882)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSQVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22221 1C11[PD-1]_L3.207 (SEQ ID NO: 883)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSDVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22222 1C11[PD-1]_L3.208 (SEQ ID NO: 884)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSFVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XenD22223 1C11[PD-1]_L3.209 (SEQ ID NO: 885)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSTVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 97A

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 22538 | 1C11_H3_L3 | 1.84E-08 | 2.14E+05 | 3.93E-03 | | | 53.5 |
| 23577 | 1C11_H3_L3.1 | 9.95E-09 | 2.40E+05 | 2.38E-03 | | V2I | 53.5 |
| 23579 | 1C11_H3_L3.3 | 1.54E-08 | 1.74E+05 | 2.68E-03 | | L3V | 54.5 |
| 23589 | 1C11_H3_L3.15 | 1.50E-08 | 2.45E+05 | 3.67E-03 | | A12S | 53.5 |
| 23601 | 1C11_H3_L3.23 | 3.87E-08 | 1.26E+05 | 4.90E-03 | | A19V | 54 |
| 23605 | 1C11_H3_L3.28 | 1.57E-08 | 2.16E+05 | 3.39E-03 | | K24R | 53.5 |
| 23609 | 1C11_H3_L3.32 | 2.20E-08 | 2.90E+05 | 6.37E-03 | | S25A | 54 |
| 24201 | 1C11_H3_L3.113 | 1.98E-08 | 1.98E+05 | 3.92E-03 | | Q48K | 54 |
| 23615 | 1C11_H3_L3.46 | 1.88E-08 | 2.51E+05 | 4.73E-03 | | S49P | 54 |
| 23616 | 1C11_H3_L3.47 | 1.21E-08 | 4.26E+05 | 5.14E-03 | | S49A | 54 |
| 23624 | 1C11_H3_L3.57 | 1.45E-08 | 2.55E+05 | 3.68E-03 | | S62T | 53.5 |
| 24207 | 1C11_H3_L3.122 | 1.16E-09 | 5.68E+05 | 6.61E-04 | | V64I | 53.5 |
| 24208 | 1C11_H3_L3.124 | 1.62E-08 | 1.80E+05 | 2.92E-03 | | D66A | 53.5 |
| 23626 | 1C11_H3_L3.59 | 1.03E-08 | 3.41E+05 | 3.52E-03 | | S83R | 53 |
| 23628 | 1C11_H3_L3.62 | 1.55E-08 | 1.68E+05 | 2.60E-03 | | L84M | 54 |
| 23629 | 1C11_H3_L3.63 | 4.51E-08 | 9.98E+04 | 4.50E-03 | | L84V | 55 |
| 24209 | 1C11_H3_L3.125 | 6.81E-09 | 3.50E+05 | 2.38E-03 | | L84V Q85E | 54.5 |
| 23633 | 1C11_H3_L3.69 | 3.38E-08 | 2.04E+05 | 6.91E-03 | | V89A | 54 |
| 23636 | 1C11_H3_L3.73 | 1.19E-08 | 2.22E+05 | 2.65E-03 | | V91T | 54 |
| 23640 | 1C11_H3_L3.81 | 2.33E-08 | 1.51E+05 | 3.52E-03 | | G108Q | 54 |
| 24210 | 1C11_H3_L3.132 | 1.63E-08 | 1.81E+05 | 2.95E-03 | | G108P | 53.5 |
| 24372 | 1C11_H3_L3.86 | 1.94E-08 | 2.06E+05 | 3.98E-03 | | S62T L84V V91T G108Q | 55.5 |
| 24373 | 1C11_H3_L3.87 | 2.17E-08 | 1.60E+05 | 3.48E-03 | | L3V A19V S25A S49P | 56 |
| 24374 | 1C11_H3_L3.90 | 2.50E-08 | 1.70E+05 | 4.26E-03 | | L3V S25A S49P L84V V89A V91T G108Q | 57 |
| 24375 | 1C11_H3_L3.92 | 1.89E-08 | 1.70E+05 | 3.22E-03 | | V2I L3V A19V S25A S49P S62T | 56 |

Figure 97B

| XENP | Variant Name | $K_D$ (M) | $k_a$ (1/Ms) | $k_d$ (1/s) | VH Variants | VL Variants | $T_m$ (°C) |
|---|---|---|---|---|---|---|---|
| 24376 | 1C11_H3_L3.94 | 1.85E-08 | 1.77E+05 | 3.27E-03 | | V2I S62T L84V V89A V91T G108Q | 56 |
| 24377 | 1C11_H3_L3.96 | 2.65E-08 | 1.63E+05 | 4.33E-03 | | V2I L3V S25A S49P S62T L84V V89A V91T G108Q | 57.5 |
| 24378 | 1C11_H3_L3.105 | 2.04E-08 | 1.88E+05 | 3.85E-03 | | A12P S14T L15P R18P | 71.5 |
| 24379 | 1C11_H3_L3.129 | | | | | S82N V89A V91T F95H | 49.5 |
| 24380 | 1C11_H3.176_L3.92 | | | | D66P T69K | V2I L3V A19V S25A S49P S62T | 59 |
| 24381 | 1C11_H3.176_L3.94 | | | | D66P T69K | V2I S62T L84V V89A V91T G108Q | 60 |
| 24382 | 1C11_H3.176_L3.96 | | | | D66P T69K | V2I L3V S25A S49P S62T L84V V89A V91T G108Q | 62 |
| 24414 | 1C11_H3_L3.133 | | | | | L3V A19V S25A S49P L84V V89A V91T G108Q | 58.5 |
| 24415 | 1C11_H3_L3.134 | | | | | L3V A19V S25A S49P L84V Q85E V89A V91T G108Q | 58 |
| 24416 | 1C11_H3_L3.135 | | | | | L3V A19V S25A S49P L84M V89A V91T G108Q | 57.5 |
| 24417 | 1C11_H3_L3.136 | | | | | L3V A19I S25A S49P L84M V89A V91T G108Q | 57 |

Figure 97C

| XENP | Variant Name | K_D (M) | k_a (1/Ms) | k_d (1/s) | VH Variants | VL Variants | Tm (°C) |
|---|---|---|---|---|---|---|---|
| 24418 | 1C11_H3_L3.137 | | | | | L3V A19I S25A S49P L84V V89A V91T G108Q | 58 |
| 24419 | 1C11_H3_L3.138 | | | | | L3V A19I S25A S49P L84V Q85E V89A V91T G108Q | 58 |
| 24420 | 1C11_H3_L3.139 | | | | | L3V S25A S49P V64I L84V V89A V91T G108Q | 57.5 |
| 24421 | 1C11_H3_L3.140 | | | | | V2I L3V S25A L84V Q85E V91T G108Q | 56 |
| 24422 | 1C11_H3_L3.141 | 3.37E-08 | 2.63E+05 | 8.87E-03 | | V2I L3V S25A S49P L84V Q85E V91T G108Q | 57 |
| 24423 | 1C11_H3_L3.142 | 3.55E-08 | 2.50E+05 | 8.86E-03 | | V2I L3V S25A S49A L84V Q85E V91T G108Q | 57 |
| 24422 | 1C11_H3_L3.141 | | | | | V2I L3V S25A S49P L84V Q85E V91T G108Q | 56.5 |
| 24853 | 1C11_H3_L3.143 | | | | | V2I L3V A19V S25A S49P L84V Q85E V91T G108Q | 57.5 |
| 24854 | 1C11_H3_L3.144 | | | | | V2I L3V A19V S25A S49P L84V Q85E V89A V91T G108Q | 58.5 |

Figure 97D

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24855 | 1C11_H3_L3.145 | | | | | V2I L3V A19V S25A L84V Q85E V91T G108Q | 56.5 |
| 24856 | 1C11_H3_L3.146 | | | | | V2I L3V A19V S25A L84V Q85E V89A V91T G108Q | 57.5 |
| 24857 | 1C11_H3_L3.147 | | | | | V2I L3V A19V S25A S49A L84V Q85E V91T G108Q | 57 |
| 24858 | 1C11_H3_L3.148 | | | | | V2I L3V A19V S25A S49A L84V Q85E V89A V91T G108Q | 58 |
| 24218 | 1C11_H3.86_L3 | 1.90E-08 | 1.64E+05 | 3.12E-03 | Q1E | | |
| 23755 | 1C11_H3.1_L3 | 2.42E-08 | 1.57E+05 | 3.80E-03 | I2V | | |
| 23758 | 1C11_H3.5_L3 | 1.91E-08 | 2.48E+05 | 4.73E-03 | S9A | | |
| 23760 | 1C11_H3.7_L3 | 4.19E-08 | 1.76E+05 | 7.37E-03 | S9P | | |
| 24221 | 1C11_H3.90_L3 | 2.53E-08 | 1.68E+05 | 4.24E-03 | E10V | | |
| 24222 | 1C11_H3.91_L3 | 2.47E-08 | 1.72E+05 | 4.26E-03 | K12V | | |
| 24226 | 1C11_H3.95_L3 | 2.00E-08 | 1.92E+05 | 3.84E-03 | A16G | | |
| 24227 | 1C11_H3.96_L3 | 2.30E-08 | 1.74E+05 | 4.00E-03 | A16Q | | |
| 24228 | 1C11_H3.97_L3 | 2.42E-08 | 1.87E+05 | 4.52E-03 | A16E | | |
| 24247 | 1C11_H3.120_L3 | 2.14E-08 | 2.02E+05 | 4.32E-03 | M36I | | |
| 23765 | 1C11_H3.18_L3 | 1.56E-08 | 1.51E+05 | 2.35E-03 | R40K | | |
| 24250 | 1C11_H3.125_L3 | 1.80E-08 | 2.04E+05 | 3.66E-03 | A42P | | |
| 24254 | 1C11_H3.129_L3 | 2.37E-08 | 3.03E+05 | 7.19E-03 | M50I | | |
| 24256 | 1C11_H3.134_L3 | 2.17E-08 | 2.48E+05 | 5.38E-03 | Y56K | | |
| 23770 | 1C11_H3.25_L3 | 3.40E-08 | 1.84E+05 | 6.25E-03 | Y56N | | |
| 24263 | 1C11_H3.143_L3 | 3.19E-08 | 2.02E+05 | 6.46E-03 | T63Y | | |
| 24266 | 1C11_H3.146_L3 | 2.30E-08 | 2.20E+05 | 5.06E-03 | D66P | | |
| 24267 | 1C11_H3.147_L3 | 2.04E-08 | 2.22E+05 | 4.52E-03 | D66T | | |
| 24268 | 1C11_H3.148_L3 | 2.26E-08 | 1.89E+05 | 4.26E-03 | D66Q G67K | | |
| 23776 | 1C11_H3.35_L3 | 6.92E-08 | 6.25E+04 | 4.32E-03 | G67K | | |
| 23779 | 1C11_H3.41_L3 | 3.44E-08 | 1.04E+05 | 3.57E-03 | T69K | | |
| 23780 | 1C11_H3.42_L3 | 2.78E-08 | 1.09E+05 | 3.04E-03 | T69Q | | |

Figure 97E

| XENP | Variant Name | $K_D$ (M) | $k_a$ (1/Ms) | $k_d$ (1/s) | VH Variants | VL Variants | $T_m$ (°C) |
|---|---|---|---|---|---|---|---|
| 24270 | 1C11_H3.150_L3 | 1.89E-08 | 2.02E+05 | 3.81E-03 | G70E | | |
| 23781 | 1C11_H3.43_L3 | 1.60E-08 | 2.42E+05 | 3.89E-03 | F72V | | |
| 23786 | 1C11_H3.50_L3 | 1.80E-08 | 1.40E+05 | 2.52E-03 | L76V | | |
| 24274 | 1C11_H3.154_L3 | 2.24E-08 | 1.99E+05 | 4.46E-03 | L76I | | |
| 23793 | 1C11_H3.59_L3 | 9.74E-09 | 4.40E+05 | 4.28E-03 | V80Q | | |
| 24279 | 1C11_H3.159_L3 | 2.29E-08 | 2.39E+05 | 5.45E-03 | S81D | | |
| 24278 | 1C11_H3.158_L3 | 1.59E-08 | 2.19E+05 | 3.48E-03 | S81N | | |
| 23796 | 1C11_H3.62_L3 | 1.62E-08 | 3.90E+05 | 6.32E-03 | A83I | | |
| 24287 | 1C11_H3.168_L3 | 2.25E-08 | 1.96E+05 | 4.40E-03 | S88N | | |
| 24291 | 1C11_H3.172_L3 | 2.41E-08 | 2.10E+05 | 5.06E-03 | A92P | | |
| 23811 | 1C11_H3.74_L3 | 3.90E-08 | 2.00E+05 | 7.82E-03 | F99Y | | |
| 24211 | 1C11_H3.78_L3 | 4.75E-08 | 2.37E+05 | 1.13E-02 | S9P Y56N L76V V80Q | | |
| 24212 | 1C11_H3.80_L3 | 3.88E-08 | 2.64E+05 | 1.02E-02 | Y56N L76V V80Q F99Y | | |
| 24213 | 1C11_H3.81_L3 | 2.22E-08 | 1.94E+05 | 4.30E-03 | G67K T69K | | |
| 24214 | 1C11_H3.82_L3 | 1.60E-08 | 1.98E+05 | 3.16E-03 | G67K T69Q | | |
| 24215 | 1C11_H3.83_L3 | 3.57E-08 | 2.71E+05 | 9.67E-03 | Y56N L76V V80Q | | |
| 24216 | 1C11_H3.84_L3 | 2.01E-08 | 1.78E+05 | 3.59E-03 | G67K T69K V80Q | | |
| 24217 | 1C11_H3.85_L3 | 1.78E-08 | 1.92E+05 | 3.41E-03 | G67K T69Q V80Q | | |
| 24424 | 1C11_H3.176_L3 | | | | D66P T69K | | 58 |
| 24425 | 1C11_H3.177_L3 | | | | D66P G67K | | 58.5 |
| 24426 | 1C11_H3.178_L3 | | | | D66P T69K G70E | | 59 |
| 24427 | 1C11_H3.179_L3 | | | | D66P G67K G70E | | 58.5 |
| 24428 | 1C11_H3.180_L3 | | | | M36I L76V | | 55.5 |
| 24429 | 1C11_H3.181_L3 | | | | M36I L76I | | 55.5 |
| 24430 | 1C11_H3.182_L3 | | | | K12V A16E | | 54 |
| 24431 | 1C11_H3.183_L3 | | | | E10V A16E | | 56 |
| 24432 | 1C11_H3.184_L3 | | | | E10V K12V A16E | | 55.5 |
| 24433 | 1C11_H3.185_L3 | | | | Q1E I2V K12V A16E M36I A42P M50I T63Y D66P G67K G70E V80Q S81D S88N F99Y | | 61 |

Figure 97F

| XENP | Variant Name | K<sub>D</sub> (M) | k<sub>a</sub> (1/Ms) | k<sub>d</sub> (1/s) | VH Variants | VL Variants | T<sub>m</sub> (°C) |
|---|---|---|---|---|---|---|---|
| 24434 | 1C11_H3.186_L3 | | | | Q1E I2V K12V A16E M36I A42P T63Y D66P G70E S81D S88N F99Y | | 61.5 |
| 24435 | 1C11_H3.187_L3 | | | | I2V K12V A16E M36I A42P T63Y D66P G70E V80Q S88N F99Y | | 62 |
| 24436 | 1C11_H3.188_L3 | 5.32E-08 | 3.20E+05 | 1.71E-02 | I2V A16E M36I A42P M50I T63Y D66P V80Q S88N F99Y | | 62.5 |
| 24437 | 1C11_H3.189_L3 | | | | I2V M36I A42P M50I T63Y D66P G67K S88N F99Y | | 61 |
| 24438 | 1C11_H3.190_L3 | | | | I2V E10V A16G M36I A42P M50I T63Y D66P V80Q S88N F99Y | | 60.5 |
| 24439 | 1C11_H3.191_L3 | | | | I2V K12V A16E D66P V80Q S88N | | 58.5 |
| 24440 | 1C11_H3.192_L3 | | | | Q1E I2V E10V A16E M36I G70E | | 58 |
| 24441 | 1C11_H3.193_L3 | | | | A42P M50I D66P G70E V80Q S88N F99Y | | 59.5 |
| 24442 | 1C11_H3.194_L3 | | | | Q1E E10V M36I M50I | | 56 |

| XENP | Variant Name | K_D (M) | k_a (1/Ms) | k_d (1/s) | VH Variants | VL Variants | T_m (°C) |
|---|---|---|---|---|---|---|---|
| 24443 | 1C11_H3.195_L3 | | | | A42P T63Y S81D S88N | | 55 |
| 24436 | 1C11_H3.188_L3 | | | | I2V A16E M36I A42P M50I T63Y D66P V80Q S88N F99Y | | 61.5 |
| 24827 | 1C11_H3.196_L3 | | | | Q1E I2V A16E M36I A42P M50I T63Y D66P V80Q S88N F99Y | | 61 |
| 24828 | 1C11_H3.197_L3 | | | | I2V M36I A42P M50I T63Y D66P V80Q S88N F99Y | | 60 |
| 24829 | 1C11_H3.198_L3 | | | | I2V A16E M36I A42P M50I T63Y V80Q S88N F99Y | | 59 |
| 24830 | 1C11_H3.199_L3 | | | | I2V A16E A42P M50I T63Y D66P V80Q S88N F99Y | | 60.5 |
| 24831 | 1C11_H3.200_L3 | | | | I2V A16E M36I A42P M50I T63Y D66P V80Q S88N | | 61 |
| 24832 | 1C11_H3.201_L3 | | | | I2V A16E M36I A42P M50I T63Y D66P L76I V80Q S88N F99Y | | 62 |
| 24833 | 1C11_H3.202_L3 | | | | I2V A16E M36I M50I T63Y D66P V80Q S88N F99Y | | 61.5 |

Figure 97H

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24834 | 1C11_H3.203_L3 | | | | I2V A16E M36I A42P M50I T63Y D66P G70E V80Q S88N F99Y | | 62.5 |
| 24835 | 1C11_H3.204_L3 | | | | I2V A16E M36I A42P M50I T63Y D66P T69Q V80Q S88N F99Y | | 62.5 |
| 24836 | 1C11_H3.205_L3 | | | | I2V A16E M36I A42P M50I T63Y D66P T69K V80Q S88N F99Y | | 62.5 |
| 24837 | 1C11_H3.206_L3 | | | | I2V A16E M36I A42P M50I D66P V80Q S88N F99Y | | 62 |
| 24838 | 1C11_H3.207_L3 | | | | I2V A16E M36I A42P M50I T63Y D66P V80Q F99Y | | 61.5 |
| 24839 | 1C11_H3.208_L3 | | | | I2V A16E M36I A42P M50I T63Y D66P V80Q S81D S88N F99Y | | 61.5 |
| 24840 | 1C11_H3.209_L3 | | | | I2V A16E M36I A42P T63Y D66P V80Q S88N F99Y | | 63 |
| 24841 | 1C11_H3.210_L3 | | | | I2V A16E M36I A42P M50I T63Y D66P S88N F99Y | | 61.5 |

Figure 97I

| XENP | Variant Name | K$^D$ (M) | k$_a$ (1/Ms) | k$_d$ (1/s) | VH Variants | VL Variants | T$_m$ (°C) |
|---|---|---|---|---|---|---|---|
| 24842 | 1C11_H3.211_L3 | | | | I2V S9P A16E M36I A42P M50I T63Y D66P V80Q S88N F99Y | | 63.5 |
| 24843 | 1C11_H3.212_L3 | | | | I2V A16E M36I A42P M50I T63Y D66P S81D S88N F99Y | | 61 |
| 24844 | 1C11_H3.213_L3 | | | | I2V S9P A16E M36I M50I T63Y D66P V80Q S81D S88N F99Y | | 62.5 |
| 24845 | 1C11_H3.214_L3 | | | | I2V S9P A16E M36I M50I T63Y D66P L76I V80Q S88N F99Y | | 62.5 |
| 24846 | 1C11_H3.215_L3 | | | | I2V S9P A16E M36I M50I T63Y D66P S88N F99Y | | 62.5 |
| 24847 | 1C11_H3.216_L3 | | | | I2V S9P A16E M36I A42P T63Y D66P L76I V80Q S88N F99Y | | 65.5 |
| 24848 | 1C11_H3.217_L3 | | | | I2V S9P A16E M36I A42P T63Y D66P S88N F99Y | | 64 |
| 24849 | 1C11_H3.218_L3 | | | | I2V S9P A16E M36I A42P T63Y D66P V80Q S81D S88N F99Y | | 63.5 |

Figure 97J

| XENP | Variant Name | K_D (M) | k_a (1/Ms) | k_d (1/s) | VH Variants | VL Variants | T_m (°C) |
|---|---|---|---|---|---|---|---|
| 24850 | 1C11_H3.219_L3 | | | | I2V A16E M36I A42P M50I T63Y D66P T69Q G70E V80Q S88N F99Y | | 63 |
| 24851 | 1C11_H3.220_L3 | | | | I2V A16E M36I A42P M50I T63Y D66P T69K G70E V80Q S88N F99Y | | 62.5 |
| 24852 | 1C11_H3.221_L3 | | | | Q1E A16E M36I A42P M50I T63Y D66P V80Q S88N F99Y | | |
| 25295 | 1C11_H3.222_L3 | | | | I2V S9P A16E M36I A42P D66P L76I V80Q S88N F99Y | | 64 |
| 25296 | 1C11_H3.223_L3 | 3.21E-08 | | | I2V S9P A16E M36I A42P T63Y D66P G70E L76I V80Q S88N F99Y | | 67 |
| 25301 | 1C11_H3.224_L3 | 3.06E-08 | | | I2V S9P A16E M36I A42P T63Y D66P T69Q G70E L76I V80Q S88N F99Y | | 67 |
| 25302 | 1C11_H3.225_L3 | 3.22E-08 | | | I2V S9P A16E M36I T63Y D66P G70E V80Q S81D S88N F99Y | | 64.5 |
| 25303 | 1C11_H3.226_L3 | 3.35E-08 | | | I2V S9P A16E M36I T63Y D66P T69Q G70E V80Q S81D S88N F99Y | | 64.5 |

Figure 97K

| XENP | Variant Name | K_D (M) | k_a (1/Ms) | k_d (1/s) | VH Variants | VL Variants | T_m (°C) |
|---|---|---|---|---|---|---|---|
| 25304 | 1C11_H3.227_L3 | | | | Q1E I2V S9P A16E M36I T63Y D66P G70E V80Q S81D S88N F99Y | | 64.5 |
| 25305 | 1C11_H3.228_L3 | | | | Q1E I2V S9P A16E M36I T63Y D66P T69Q G70E V80Q S81D S88N F99Y | | 65 |
| 25306 | 1C11_H3.229_L3 | 3.79E-08 | | | I2V A16E M36I A42P T63Y D66P T69Q G70E V80Q S88N F99Y | | 64.5 |
| 25307 | 1C11_H3.230_L3 | 4.19E-08 | | | I2V A16E M36I A42P T63Y D66P T69Q G70E V80Q S81D S88N F99Y | | 64 |
| 25308 | 1C11_H3.231_L3 | 3.01E-08 | | | I2V A16E M36I A42P D66P V80Q F99Y | | 61.5 |
| 25309 | 1C11_H3.232_L3 | 3.32E-08 | | | I2V A16E M36I A42P D66P V80Q S81D S88N F99Y | | 61.5 |
| 25310 | 1C11_H3.233_L3 | | | | Q1E I2V A16E M36I A42P T63Y D66P T69Q G70E V80Q S88N F99Y | | 64.5 |
| 25311 | 1C11_H3.234_L3 | | | | Q1E I2V A16E M36I A42P T63Y D66P T69Q G70E V80Q S81D S88N F99Y | | 63.5 |

Figure 97L

| XENP | Variant Name | K_D (M) | k_a (1/Ms) | k_d (1/s) | VH Variants | VL Variants | T_m (°C) |
|---|---|---|---|---|---|---|---|
| 25312 | 1C11_H3.235_L3 | 3.14E-08 | | | Q1E I2V A16E M36I A42P D66P V80Q F99Y | | 61.5 |
| 25313 | 1C11_H3.236_L3 | 3.94E-08 | | | Q1E I2V A16E M36I A42P D66P V80Q S81D S88N F99Y | | 61.5 |
| 25314 | 1C11_H3.237_L3 | 3.44E-08 | | | I2V A16E M36I T63Y D66P G70E V80Q S81D S88N F99Y | | 63 |
| 25315 | 1C11_H3.238_L3 | 3.84E-08 | | | I2V A16E M36I T63Y D66P T69Q G70E V80Q S81D S88N F99Y | | 63.5 |
| 25316 | 1C11_H3.213_L3.144 | | | | I2V S9P A16E M36I M50I T63Y D66P V80Q S81D S88N F99Y | | 60, 71.5 |
| 25317 | 1C11_H3.213_L3.148 | | | | I2V S9P A16E M36I M50I T63Y D66P V80Q S81D S88N F99Y | | 59.5, 70.5 |
| 25318 | 1C11_H3.216_L3.144 | | | | I2V S9P A16E M36I A42P T63Y D66P L76I V80Q S88N F99Y | | 73 |
| 25319 | 1C11_H3.216_L3.148 | | | | I2V S9P A16E M36I A42P T63Y D66P L76I V80Q S88N F99Y | | 72.5 |

Figure 97M

| XENP | Variant Name | K_D (M) | k_a (1/Ms) | k_d (1/s) | VH Variants | VL Variants | T_m (°C) |
|---|---|---|---|---|---|---|---|
| 25320 | 1C11_H3.188_L3.144 | 5.04E-08 | | | I2V A16E M36I A42P M50I T63Y D66P V80Q S88N F99Y | V2I L3V A19V S25A S49P L84V Q85E V89A V91T G108Q | 60, 71 |
| 25321 | 1C11_H3.188_L3.148 | 4.13E-08 | | | I2V A16E M36I A42P M50I T63Y D66P V80Q S88N F99Y | V2I L3V A19V S25A S49A L84V Q85E V89A V91T G108Q | 59.5, 70.5 |
| 25802 | 1C11_H3.224_L3.144 | 3.31E-08 | | | I2V S9P A16E M36I A42P T63Y D66P T69Q G70E L76I V80Q S88N F99Y | V2I L3V A19V S25A S49P L84V Q85E V89A V91T G108Q | |
| 25803 | 1C11_H3.224_L3.148 | 3.12E-08 | | | I2V S9P A16E M36I A42P T63Y D66P T69Q G70E L76I V80Q S88N F99Y | V2I L3V A19V S25A S49A L84V Q85E V89A V91T G108Q | |
| (25338) | 1C11_H3.226_L3.144 | 4.37E-08 | | | I2V S9P A16E M36I T63Y D66P T69Q G70E V80Q S81D S88N F99Y | V2I L3V A19V S25A S49P L84V Q85E V89A V91T G108Q | |
| (25339) | 1C11_H3.226_L3.148 | 4.18E-08 | | | I2V S9P A16E M36I T63Y D66P T69Q G70E V80Q S81D S88N F99Y | V2I L3V A19V S25A S49A L84V Q85E V89A V91T G108Q | |
| 24436 | 1C11_H3.188_L3 | 5.32E-08 | | | I2V A16E M36I A42P M50I T63Y D66P V80Q S88N F99Y | | |
| 24422 | 1C11_H3_L3.141 | 3.37E-08 | | | | V2I L3V S25A S49P L84V Q85E V91T G108Q | |

Figure 97N

| XENP | Variant Name | K_D (M) | k_a (1/Ms) | k_d (1/s) | VH Variants | VL Variants | T_m (°C) |
|---|---|---|---|---|---|---|---|
| 24423 | 1C11_H3_L3.142 | 3.55E-08 | | | | V2I L3V S25A S49A L84V Q85E V91T G108Q | |
| 25802 | 1C11_H3.224_L3.144 | 3.31E-08 | | | I2V S9P A16E M36I A42P T63Y D66P T69Q G70E L76I V80Q S88N F99Y | V2I L3V A19V S25A S49P L84V Q85E V89A V91T G108Q | 74 |
| 25803 | 1C11_H3.224_L3.148 | 3.12E-08 | | | I2V S9P A16E M36I A42P T63Y D66P T69Q G70E L76I V80Q S88N F99Y | V2I L3V A19V S25A S49A L84V Q85E V89A V91T G108Q | 73.5 |
| 25804 | 1C11_H3.228_L3.144 | 3.88E-08 | 2.59E+05 | 1.00E-02 | Q1E I2V S9P A16E M36I T63Y D66P T69Q G70E V80Q S81D S88N F99Y | V2I L3V A19V S25A S49P L84V Q85E V89A V91T G108Q | 62, 72.5 |
| 25805 | 1C11_H3.228_L3.148 | 4.19E-08 | 2.37E+05 | 9.94E-03 | Q1E I2V S9P A16E M36I T63Y D66P T69Q G70E V80Q S81D S88N F99Y | V2I L3V A19V S25A S49A L84V Q85E V89A V91T G108Q | 62, 72 |
| 25806 | 1C11_H3.234_L3.144 | 2.74E-08 | 2.83E+05 | 7.75E-03 | Q1E I2V A16E M36I A42P T63Y D66P T69Q G70E V80Q S81D S88N F99Y | V2I L3V A19V S25A S49P L84V Q85E V89A V91T G108Q | 60.5, 71.5 |
| 25807 | 1C11_H3.234_L3.148 | 3.75E-08 | 2.32E+05 | 8.69E-03 | Q1E I2V A16E M36I A42P T63Y D66P T69Q G70E V80Q S81D S88N F99Y | V2I L3V A19V S25A S49A L84V Q85E V89A V91T G108Q | 60.5, 71 |

Figure 97O

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 25808 | 1C11_H3.239_L3.144 | 4.26E-08 | 2.19E+05 | 9.34E-03 | Q1E I2V S9P A16E M36I A42P T63Y D66P T69Q G70E L76I V80Q S88N F99Y | V2I L3V A19V S25A S49P L84V Q85E V89A V91T G108Q | 74 |
| 25809 | 1C11_H3.240_L3.144 | 4.31E-08 | 2.43E+05 | 1.05E-02 | I2V S9P A16E M36I A42P T63Y D66P T69Q G70E L76I V80Q S81D S88N F99Y | V2I L3V A19V S25A S49P L84V Q85E V89A V91T G108Q | 73.5 |
| 25810 | 1C11_H3.241_L3.144 | 4.05E-08 | 2.18E+05 | 8.84E-03 | Q1E I2V S9P A16E M36I A42P T63Y D66P T69Q G70E L76I V80Q S81D S88N F99Y | V2I L3V A19V S25A S49P L84V Q85E V89A V91T G108Q | 73.5 |
| 25811 | 1C11_H3.239_L3.148 | 4.47E-08 | 2.27E+05 | 1.02E-02 | Q1E I2V S9P A16E M36I A42P T63Y D66P T69Q G70E L76I V80Q S88N F99Y | V2I L3V A19V S25A S49A L84V Q85E V89A V91T G108Q | 73.5 |
| 25812 | 1C11_H3.240_L3.148 | 2.75E-08 | 3.22E+05 | 8.85E-03 | I2V S9P A16E M36I A42P T63Y D66P T69Q G70E L76I V80Q S81D S88N F99Y | V2I L3V A19V S25A S49A L84V Q85E V89A V91T G108Q | 72.5 |
| 25813 | 1C11_H3.241_L3.148 | 3.33E-08 | 2.86E+05 | 9.53E-03 | Q1E I2V S9P A16E M36I A42P T63Y D66P T69Q G70E L76I V80Q S81D S88N F99Y | V2I L3V A19V S25A S49A L84V Q85E V89A V91T G108Q | 72.5 |

Figure 97P

| XENP | Variant Name | K_D (M) | k_a (1/Ms) | k_d (1/s) | VH Variants | VL Variants | T_m (°C) |
|---|---|---|---|---|---|---|---|
| 25814 | 1C11_H3.239_L3.125 | 4.16E-08 | 3.15E+05 | 1.31E-02 | Q1E I2V S9P A16E M36I A42P T63Y D66P T69Q G70E L76I V80Q S88N F99Y | L84V Q85E | 68 |
| 25815 | 1C11_H3.240_L3.125 | 5.08E-08 | 2.80E+05 | 1.42E-02 | I2V S9P A16E M36I A42P T63Y D66P T69Q G70E L76I V80Q S81D S88N F99Y | L84V Q85E | 67 |
| 25816 | 1C11_H3.241_L3.125 | 4.34E-08 | 3.34E+05 | 1.45E-02 | Q1E I2V S9P A16E M36I A42P T63Y D66P T69Q G70E L76I V80Q S81D S88N F99Y | L84V Q85E | 67 |
| 25817 | 1C11_H3.239_L3.92 | 3.46E-08 | 2.66E+05 | 9.22E-03 | Q1E I2V S9P A16E M36I A42P T63Y D66P T69Q G70E L76I V80Q S88N F99Y | V2I L3V A19V S25A S49P S62T | 71 |
| 25818 | 1C11_H3.240_L3.92 | 3.15E-08 | 3.01E+05 | 9.49E-03 | I2V S9P A16E M36I A42P T63Y D66P T69Q G70E L76I V80Q S81D S88N F99Y | V2I L3V A19V S25A S49P S62T | 70 |
| 25819 | 1C11_H3.241_L3.92 | 3.31E-08 | 3.05E+05 | 1.01E-02 | Q1E I2V S9P A16E M36I A42P T63Y D66P T69Q G70E L76I V80Q S81D S88N F99Y | V2I L3V A19V S25A S49P S62T | 70 |

Figure 97Q

| XENP | Variant Name | K$_D$ (M) | k$_a$ (1/Ms) | k$_d$ (1/s) | VH Variants | VL Variants | T$_m$ (°C) |
|---|---|---|---|---|---|---|---|
| 24854 | 1C11_H3_L3.144 | 3.01E-08 | 2.20E+05 | 6.61E-03 | | V2I L3V A19V S25A S49P L84V Q85E V89A V91T G108Q | 58.5 |
| 24858 | 1C11_H3_L3.148 | 2.65E-08 | 2.53E+05 | 6.69E-03 | | V2I L3V A19V S25A S49A L84V Q85E V89A V91T G108Q | 58 |
| 24847 | 1C11_H3.216_L3 | 3.79E-08 | 2.66E+05 | 1.01E-02 | I2V S9P A16E M36I A42P T63Y D66P L76I V80Q S88N F99Y | | 65.5 |
| 25305 | 1C11_H3.228_L3 | 3.70E-08 | 3.13E+05 | 1.16E-02 | Q1E I2V S9P A16E M36I T63Y D66P T69Q G70E V80Q S81D S88N F99Y | | 65 |
| 25311 | 1C11_H3.234_L3 | 3.29E-08 | 3.06E+05 | 1.01E-02 | Q1E I2V A16E M36I A42P T63Y D66P T69Q G70E V80Q S81D S88N F99Y | | 63.5 |
| 25318 | 1C11_H3.216_L3.144 | 3.87E-08 | 2.57E+05 | 9.93E-03 | I2V S9P A16E M36I A42P T63Y D66P L76I V80Q S88N F99Y | V2I L3V A19V S25A S49P L84V Q85E V89A V91T G108Q | 73 |
| 25319 | 1C11_H3.216_L3.148 | 4.36E-08 | 2.45E+05 | 1.07E-02 | I2V S9P A16E M36I A42P T63Y D66P L76I V80Q S88N F99Y | V2I L3V A19V S25A S49A L84V Q85E V89A V91T G108Q | 72.5 |

Figure 98

| XENP | Variant | $K_D$ (M) | $k_a$ (1/Ms) | $k_d$ (1/s) |
|---|---|---|---|---|
| 26321 | 1C11[PD-1]_H3.59_L3.1 | 1.28E-08 | 1.90E+05 | 2.43E-03 |
| 26322 | 1C11[PD-1]_H3.59_L3.38 | 7.15E-09 | 2.13E+05 | 1.52E-03 |
| 26323 | 1C11[PD-1]_H3.59_L3.51 | 1.54E-08 | 2.23E+05 | 3.44E-03 |
| 26324 | 1C11[PD-1]_H3.59_L3.59 | 1.74E-08 | 1.98E+05 | 3.43E-03 |
| 26325 | 1C11[PD-1]_H3.59_L3.73 | 1.86E-08 | 1.92E+05 | 3.56E-03 |
| 26326 | 1C11[PD-1]_H3.59_L3.125 | 1.78E-08 | 2.05E+05 | 3.64E-03 |
| 26327 | 1C11[PD-1]_H3.135_L3.1 | 1.45E-08 | 2.04E+05 | 2.96E-03 |
| 26328 | 1C11[PD-1]_H3.135_L3.38 | 8.90E-09 | 2.19E+05 | 1.94E-03 |
| 26329 | 1C11[PD-1]_H3.135_L3.51 | 1.86E-08 | 2.10E+05 | 3.90E-03 |
| 26330 | 1C11[PD-1]_H3.135_L3.59 | 1.66E-08 | 2.30E+05 | 3.82E-03 |
| 26331 | 1C11[PD-1]_H3.135_L3.73 | 1.81E-08 | 2.10E+05 | 3.81E-03 |
| 26332 | 1C11[PD-1]_H3.135_L3.125 | 1.92E-08 | 2.05E+05 | 3.93E-03 |
| 26333 | 1C11[PD-1]_H3.138_L3.1 | 1.81E-08 | 1.92E+05 | 3.49E-03 |
| 26334 | 1C11[PD-1]_H3.138_L3.38 | 1.33E-08 | 1.99E+05 | 2.64E-03 |
| 26335 | 1C11[PD-1]_H3.138_L3.51 | 2.61E-08 | 2.01E+05 | 5.25E-03 |
| 26336 | 1C11[PD-1]_H3.138_L3.59 | 1.92E-08 | 2.31E+05 | 4.44E-03 |
| 26337 | 1C11[PD-1]_H3.138_L3.73 | 1.94E-08 | 3.26E+05 | 6.32E-03 |
| 26338 | 1C11[PD-1]_H3.138_L3.125 | 2.20E-08 | 3.19E+05 | 7.01E-03 |
| 26339 | 1C11[PD-1]_H3.155_L3.1 | 1.78E-08 | 3.05E+05 | 5.41E-03 |
| 26340 | 1C11[PD-1]_H3.155_L3.38 | 1.42E-08 | 3.20E+05 | 4.55E-03 |
| 26341 | 1C11[PD-1]_H3.155_L3.51 | 2.86E-08 | 2.80E+05 | 8.01E-03 |
| 26342 | 1C11[PD-1]_H3.155_L3.59 | 2.27E-08 | 3.10E+05 | 7.03E-03 |
| 26343 | 1C11[PD-1]_H3.155_L3.73 | 2.55E-08 | 2.91E+05 | 7.41E-03 |
| 26344 | 1C11[PD-1]_H3.155_L3.125 | 2.03E-08 | 3.66E+05 | 7.41E-03 |
| 22553 | 1C11[PD-1]_H3L3 | 1.94E-08 | 3.24E+05 | 6.29E-03 |

Figure 99

| XENP | Variant Name | K$_D$ (M) | k$_a$ (1/Ms) | k$_d$ (1/s) |
|---|---|---|---|---|
| 22553 | 1C11_H3L3 | 2.98E-08 | 3.70E+05 | 1.10E-02 |
| 26322 | 1C11_H3.59_L3.38 | 1.27E-08 | 3.13E+05 | 3.99E-03 |
| 26917 | 1C11_H3.244_L3 | 6.48E-08 | 4.54E+05 | 2.94E-02 |
| 26918 | 1C11_H3.249_L3 | 6.00E-08 | 4.91E+05 | 2.95E-02 |
| 26919 | 1C11_H3.250_L3 | 3.16E-07 | 3.65E+05 | 1.15E-01 |
| 26920 | 1C11_H3.256_L3 | 2.95E-08 | 3.07E+05 | 9.05E-03 |
| 26921 | 1C11_H3.258_L3 | 2.53E-08 | 4.16E+05 | 1.05E-02 |
| 26922 | 1C11_H3.288_L3 | 1.95E-08 | 4.18E+05 | 8.16E-03 |
| 26923 | 1C11_H3.292_L3 | 2.02E-08 | 3.34E+05 | 6.75E-03 |
| 26924 | 1C11_H3.303_L3 | 1.48E-08 | 3.60E+05 | 5.34E-03 |
| 26925 | 1C11_H3_L3.149 | 7.35E-09 | 6.55E+05 | 4.82E-03 |
| 26926 | 1C11_H3_L3.152 | 6.27E-09 | 4.55E+05 | 2.85E-03 |
| 26927 | 1C11_H3_L3.160 | 4.29E-07 | 1.95E+05 | 8.37E-02 |
| 26928 | 1C11_H3_L3.161 | 3.33E-07 | 3.51E+05 | 1.17E-01 |
| 26929 | 1C11_H3_L3.166 | 3.14E-08 | 4.25E+05 | 1.34E-02 |
| 26930 | 1C11_H3_L3.168 | 3.18E-08 | 4.57E+05 | 1.45E-02 |
| 26931 | 1C11_H3_L3.180 | 1.14E-07 | 3.64E+05 | 4.13E-02 |
| 26932 | 1C11_H3_L3.186 | 6.14E-08 | 4.25E+05 | 2.61E-02 |
| 26933 | 1C11_H3_L3.191 | 5.89E-08 | 4.40E+05 | 2.59E-02 |
| 26934 | 1C11_H3_L3.194 | 1.04E-07 | 2.44E+05 | 2.54E-02 |
| 26935 | 1C11_H3_L3.202 | 2.64E-08 | 3.69E+05 | 9.74E-03 |
| 26936 | 1C11_H3_L3.204 | 2.97E-08 | 3.86E+05 | 1.15E-02 |
| 26937 | 1C11_H3_L3.207 | 3.14E-08 | 2.94E+05 | 9.23E-03 |
| 26938 | 1C11_H3.308_L3.152 | 1.42E-08 | 1.79E+05 | 2.53E-03 |
| 26939 | 1C11_H3.59_L3.152 | 1.56E-08 | 4.02E+05 | 6.25E-03 |
| 26940 | 1C11_H3.303_L3.152 | 3.41E-09 | 5.18E+05 | 1.77E-03 |
| 26941 | 1C11_H3.308_L3.180 | 4.34E-08 | 4.97E+05 | 2.16E-02 |
| 26942 | 1C11_H3.59_L3.180 | 5.74E-08 | 4.45E+05 | 2.55E-02 |
| 26943 | 1C11_H3.303_L3.180 | 4.20E-08 | 3.53E+05 | 1.48E-02 |
| 26944 | 1C11_H3.303_L3.210 | 1.04E-08 | 4.14E+05 | 4.28E-03 |
| 26945 | 1C11_H3.308_L3 | 3.22E-08 | 4.00E+05 | 1.29E-02 |
| 26946 | 1C11_H3.59_L3 | 3.71E-08 | 4.90E+05 | 1.81E-02 |
| 26947 | 1C11_H3.135_L3 | 4.76E-08 | 3.75E+05 | 1.79E-02 |
| 26949 | 1C11_H3.308_L3.210 | 2.37E-08 | 2.84E+05 | 6.71E-03 |
| 26950 | 1C11_H3_L3.210 | 1.98E-08 | 2.25E+05 | 4.45E-03 |
| 26951 | 1C11_H3_L3.1 | 4.71E-08 | 2.38E+05 | 1.12E-02 |
| 26952 | 1C11_H3_L3.38 | 2.85E-08 | 3.44E+05 | 9.79E-03 |
| 26953 | 1C11_H3_L3.125 | 5.60E-08 | 4.16E+05 | 2.33E-02 |
| 26954 | 1C11_H3.308_L3.38 | 2.29E-08 | 3.31E+05 | 7.58E-03 |
| 26955 | 1C11_H3.59_L3.210 | 1.98E-08 | 2.89E+05 | 5.72E-03 |

Figure 100

| TA | Variant | Human PD-1 | | |
|---|---|---|---|---|
| | | $K_D$ (M) | $k_a$ (1/Ms) | $k_d$ (1/s) |
| XENP27643 | 1C11_H3_L3.211 | 2.95E-08 | 3.57E+05 | 1.05E-02 |
| XENP27644 | 1C11_H3_L3.212 | 2.57E-08 | 3.75E+05 | 9.63E-03 |
| XENP27645 | 1C11_H3_L3.213 | 3.32E-08 | 3.16E+05 | 1.05E-02 |
| XENP27646 | 1C11_H3_L3.214 | 7.26E-08 | 4.75E+05 | 3.45E-02 |
| XENP27647 | 1C11_H3_L3.215 | 7.90E-08 | 7.89E+05 | 6.23E-02 |
| XENP27648 | 1C11_H3_L3.216 | 1.25E-07 | 7.64E+05 | 9.52E-02 |
| XENP27649 | 1C11_H3_L3.217 | 7.18E-09 | 3.81E+05 | 2.73E-03 |
| XENP27650 | 1C11_H3_L3.218 | 5.80E-09 | 3.53E+05 | 2.05E-03 |
| XENP27651 | 1C11_H3_L3.219 | 6.72E-09 | 3.40E+05 | 2.29E-03 |
| XENP27652 | 1C11_H3_L3.220 | 5.02E-09 | 3.43E+05 | 1.72E-03 |
| XENP16432 | Nivolumab_H0L0 | 1.02E-08 | 3.38E+05 | 3.43E-03 |

Figure 101

|  | | Human PD-1 | | |
| --- | --- | --- | --- | --- |
| TA | Variant | K<sub>D</sub> (M) | k<sub>a</sub> (1/Ms) | k<sub>d</sub> (1/s) |
| XENP27839 | 1C11_H3.309_L3 | 4.63E-08 | 3.02E+05 | 1.40E-02 |
| XENP27840 | 1C11_H3.310_L3 | 6.02E-08 | 2.84E+05 | 1.71E-02 |
| XENP27841 | 1C11_H3.311_L3 | 5.30E-08 | 3.06E+05 | 1.62E-02 |
| XENP27842 | 1C11_H3.312_L3 | 5.07E-08 | 3.31E+05 | 1.68E-02 |
| XENP27843 | 1C11_H3.313_L3 | 4.92E-08 | 3.14E+05 | 1.54E-02 |
| XENP27844 | 1C11_H3.314_L3 | 4.93E-08 | 3.85E+05 | 1.90E-02 |
| XENP27845 | 1C11_H3.315_L3 | 3.15E-08 | 3.40E+05 | 1.07E-02 |
| XENP27846 | 1C11_H3.316_L3 | 3.77E-08 | 3.51E+05 | 1.32E-02 |
| XENP27847 | 1C11_H3.317_L3 | 5.04E-08 | 3.41E+05 | 1.72E-02 |
| XENP27848 | 1C11_H3.318_L3 | 7.16E-08 | 2.84E+05 | 2.03E-02 |
| XENP27849 | 1C11_H3.319_L3 | 2.44E-08 | 3.31E+05 | 8.07E-03 |
| XENP27850 | 1C11_H3.320_L3 | 1.60E-08 | 2.96E+05 | 4.73E-03 |
| XENP27851 | 1C11_H3.321_L3 | 1.19E-08 | 3.95E+05 | 4.70E-03 |
| XENP27852 | 1C11_H3.322_L3 | 1.91E-08 | 3.17E+05 | 6.06E-03 |
| XENP27853 | 1C11_H3.323_L3 | 1.25E-08 | 3.87E+05 | 4.81E-03 |
| XENP27854 | 1C11_H3.324_L3 | 7.17E-09 | 4.18E+05 | 3.00E-03 |
| XENP27855 | 1C11_H3.325_L3 | 1.67E-08 | 4.03E+05 | 6.74E-03 |
| XENP27856 | 1C11_H3.326_L3 | 1.16E-08 | 3.67E+05 | 4.25E-03 |
| XENP27857 | 1C11_H3.319_L3.152 | 8.51E-09 | 3.15E+05 | 2.68E-03 |
| XENP27858 | 1C11_H3.320_L3.152 | 5.66E-09 | 3.75E+05 | 2.12E-03 |
| XENP27859 | 1C11_H3.321_L3.152 | 5.60E-09 | 3.40E+05 | 1.90E-03 |
| XENP27860 | 1C11_H3.322_L3.152 | 8.41E-09 | 3.09E+05 | 2.60E-03 |
| XENP27861 | 1C11_H3.323_L3.152 | 4.39E-09 | 3.82E+05 | 1.68E-03 |
| XENP27862 | 1C11_H3.324_L3.152 | 3.46E-09 | 4.06E+05 | 1.41E-03 |
| XENP27863 | 1C11_H3.325_L3.152 | 6.61E-09 | 4.88E+05 | 3.23E-03 |
| XENP27864 | 1C11_H3.326_L3.152 | 6.12E-09 | 5.02E+05 | 3.07E-03 |
| XENP27865 | 1C11_H3.319_L3.220 | 5.46E-09 | 3.37E+05 | 1.84E-03 |
| XENP27866 | 1C11_H3.320_L3.220 | 4.13E-09 | 3.44E+05 | 1.42E-03 |
| XENP27867 | 1C11_H3.321_L3.220 | 5.89E-09 | 4.50E+05 | 2.65E-03 |
| XENP27868 | 1C11_H3.322_L3.220 | 7.13E-09 | 4.00E+05 | 2.85E-03 |
| XENP27869 | 1C11_H3.323_L3.220 | 4.70E-09 | 3.86E+05 | 1.82E-03 |
| XENP27870 | 1C11_H3.324_L3.220 | 4.48E-09 | 4.26E+05 | 1.91E-03 |
| XENP27871 | 1C11_H3.325_L3.220 | 5.34E-09 | 5.44E+05 | 2.90E-03 |
| XENP27872 | 1C11_H3.326_L3.220 | 3.91E-09 | 3.78E+05 | 1.48E-03 |
| XENP22553 | 1C11_H3L3 | 6.19E-08 | 3.04E+05 | 1.88E-02 |
| XENP26940 | 1C11_H3.303_L3.152 | 7.36E-09 | 3.67E+05 | 2.70E-03 |

Figure 102

| | | Human PD-1 | | |
|---|---|---|---|---|
| TA | Variant | $K_D$ (M) | $k_a$ (1/Ms) | $k_d$ (1/s) |
| XENP22553 | 1C11_H3L3 | 1.54E-08 | 3.17E+05 | 4.87E-03 |
| XENP26940 | 1C11_H3.303_L3.152 | 6.74E-09 | 2.57E+05 | 1.73E-03 |
| XENP27858 | 1C11_H3.320_L3.152 | 3.07E-09 | 3.23E+05 | 9.91E-04 |
| XENP27861 | 1C11_H3.323_L3.152 | 4.14E-09 | 4.74E+05 | 1.97E-03 |
| XENP27862 | 1C11_H3.324_L3.152 | 4.48E-09 | 3.25E+05 | 1.46E-03 |
| XENP27959 | 1C11_H3.303_L3.219 | 3.58E-09 | 2.56E+05 | 9.14E-04 |
| XENP27960 | 1C11_H3.303_L3.220 | 2.30E-09 | 2.47E+05 | 5.68E-04 |
| XENP27961 | 1C11_H3.320_L3.219 | 2.75E-09 | 3.28E+05 | 9.01E-04 |
| XENP27962 | 1C11_H3.323_L3.219 | 2.32E-09 | 3.60E+05 | 8.34E-04 |
| XENP27963 | 1C11_H3.324_L3.219 | 2.96E-09 | 3.71E+05 | 1.10E-03 |

Figure 103

| | | Human PD-1 | | |
|---|---|---|---|---|
| TA | Variant | $K_D$ (M) | $k_a$ (1/Ms) | $k_d$ (1/s) |
| XENP28024 | 1C11_H3.327_L3.220 | 1.39E-09 | 2.35E+05 | 3.25E-04 |
| XENP28025 | 1C11_H3.328_L3.220 | 1.85E-09 | 2.17E+05 | 4.02E-04 |
| XENP28026 | 1C11_H3.329_L3.220 | 1.78E-09 | 2.50E+05 | 4.45E-04 |
| XENP28027 | 1C11_H3.330_L3.220 | 2.18E-09 | 3.03E+05 | 6.61E-04 |
| XENP28028 | 1C11_H3.331_L3.220 | 2.15E-09 | 3.42E+05 | 7.35E-04 |
| XENP28029 | 1C11_H3.332_L3.220 | 2.57E-09 | 2.94E+05 | 7.56E-04 |
| XENP28030 | 1C11_H3.333_L3.220 | 2.37E-09 | 2.71E+05 | 6.44E-04 |
| XENP28031 | 1C11_H3.334_L3.220 | 2.43E-09 | 2.56E+05 | 6.21E-04 |
| XENP28032 | 1C11_H3.335_L3.220 | 2.11E-09 | 2.45E+05 | 5.18E-04 |
| XENP28033 | 1C11_H3.336_L3.220 | 5.29E-09 | 1.79E+05 | 9.50E-04 |
| XENP28034 | 1C11_H3.337_L3.220 | 2.92E-09 | 2.82E+05 | 8.23E-04 |
| XENP28035 | 1C11_H3.338_L3.220 | 5.54E-09 | 2.55E+05 | 1.41E-03 |
| XENP22553 | 1C11_H3L3 | 1.80E-08 | 2.13E+05 | 3.82E-03 |
| XENP26940 | 1C11_H3.303_L3.152 | 5.18E-09 | 1.41E+05 | 7.28E-04 |
| XENP27960 | 1C11_H3.303_L3.220 | 3.35E-09 | 2.45E+05 | 8.19E-04 |
| XENP27866 | 1C11_H3.320_L3.220 | 3.26E-09 | 3.67E+05 | 1.20E-03 |
| XENP27869 | 1C11_H3.323_L3.220 | 4.13E-09 | 2.55E+05 | 1.05E-03 |
| XENP27870 | 1C11_H3.324_L3.220 | 7.56E-09 | 2.41E+05 | 1.82E-03 |
| XENP27959 | 1C11_H3.303_L3.219 | 6.47E-09 | 1.82E+05 | 1.17E-03 |
| XENP27961 | 1C11_H3.320_L3.219 | 4.22E-09 | 2.60E+05 | 1.10E-03 |
| XENP27962 | 1C11_H3.323_L3.219 | 4.58E-09 | 3.95E+05 | 1.81E-03 |
| XENP27963 | 1C11_H3.324_L3.219 | 4.63E-09 | 2.73E+05 | 1.27E-03 |

Figure 104

| TA | Variant | Human PD-1 | | | Cynomolgus PD-1 | | |
|---|---|---|---|---|---|---|---|
| | | $K_D$ (M) | ka (1/Ms) | kd (1/s) | $K_D$ (M) | ka (1/Ms) | kd (1/s) |
| XENP28651 | 1C11_H3.327_L3.152 | 4.14E-09 | 2.03E+05 | 8.41E-04 | 5.23E-09 | 3.38E+05 | 1.77E-03 |
| XENP28652 | 1C11_H3.328_L3.152 | 7.74E-09 | 1.77E+05 | 1.37E-03 | 1.10E-08 | 2.63E+05 | 2.89E-03 |
| XENP28653 | 1C11_H3.329_L3.152 | 4.95E-09 | 1.93E+05 | 9.55E-04 | 7.78E-09 | 3.59E+05 | 2.79E-03 |

Figure 105A

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3L3 | XenD17478 | XenD17482 | - | - | 5.35E-08 | 2.27E+05 | 1.22E-02 |
| 1C11_H3.59_L3.38 | XenD18576 | XenD18472 | V80Q | T37N | 1.57E-08 | 3.08E+05 | 4.83E-03 |
| 1C11_H3.242_L3 | XenD22097 | XenD17482 | G26A | - | 3.65E-08 | 2.92E+05 | 1.07E-02 |
| 1C11_H3.243_L3 | XenD22098 | XenD17482 | G26S | - | 3.08E-08 | 3.96E+05 | 1.22E-02 |
| 1C11_H3.244_L3 | XenD22099 | XenD17482 | G26T | - | 1.46E-08 | 3.82E+05 | 5.56E-03 |
| 1C11_H3.245_L3 | XenD22100 | XenD17482 | Y27W | - | 2.94E-08 | 5.02E+05 | 1.48E-02 |
| 1C11_H3.246_L3 | XenD22101 | XenD17482 | Y27L | - | 8.55E-08 | 5.15E+05 | 4.41E-02 |
| 1C11_H3.247_L3 | XenD22102 | XenD17482 | Y27H | - | 1.38E-07 | 2.73E+05 | 3.76E-02 |
| 1C11_H3.248_L3 | XenD22103 | XenD17482 | Y27Q | - | 1.06E-07 | 3.44E+05 | 3.66E-02 |
| 1C11_H3.249_L3 | XenD22104 | XenD17482 | Y27D | - | 4.70E-08 | 4.63E+05 | 2.18E-02 |
| 1C11_H3.250_L3 | XenD22105 | XenD17482 | Y27K | - | 1.50E-08 | 6.61E+05 | 9.88E-03 |
| 1C11_H3.251_L3 | XenD22106 | XenD17482 | T28V | - | 3.37E-08 | 2.48E+05 | 8.35E-03 |
| 1C11_H3.252_L3 | XenD22107 | XenD17482 | T28A | - | 7.63E-08 | 2.57E+05 | 1.96E-02 |
| 1C11_H3.253_L3 | XenD22108 | XenD17482 | T28I | - | 7.03E-08 | 2.86E+05 | 2.01E-02 |
| 1C11_H3.254_L3 | XenD22109 | XenD17482 | T28Q | - | 8.07E-08 | 2.15E+05 | 1.73E-02 |
| 1C11_H3.255_L3 | XenD22110 | XenD17482 | F29Y | - | 2.81E-08 | 3.45E+05 | 9.70E-03 |
| 1C11_H3.256_L3 | XenD22111 | XenD17482 | F29W | - | 1.86E-08 | 4.70E+05 | 8.73E-03 |
| 1C11_H3.257_L3 | XenD22112 | XenD17482 | F29H | - | 7.52E-08 | 6.83E+05 | 5.14E-02 |
| 1C11_H3.258_L3 | XenD22113 | XenD17482 | T30V | - | 1.56E-08 | 2.99E+05 | 4.68E-03 |
| 1C11_H3.259_L3 | XenD22114 | XenD17482 | T30A | - | 3.48E-08 | 3.72E+05 | 1.29E-02 |
| 1C11_H3.260_L3 | XenD22115 | XenD17482 | T30I | - | 4.18E-08 | 2.64E+05 | 1.11E-02 |
| 1C11_H3.261_L3 | XenD22116 | XenD17482 | T30Q | - | 3.05E-08 | 1.98E+05 | 6.04E-03 |
| 1C11_H3.262_L3 | XenD22117 | XenD17482 | H31Y | - | 5.45E-08 | 3.56E+05 | 1.94E-02 |
| 1C11_H3.263_L3 | XenD22118 | XenD17482 | H31Q | - | 1.15E-07 | 4.80E+05 | 5.49E-02 |
| 1C11_H3.264_L3 | XenD22119 | XenD17482 | H31D | - | 8.37E-08 | 4.58E+05 | 3.83E-02 |
| 1C11_H3.265_L3 | XenD22120 | XenD17482 | H31R | - | 1.60E-07 | 4.80E+05 | 7.66E-02 |
| 1C11_H3.266_L3 | XenD22121 | XenD17482 | H31F | - | 7.75E-08 | 5.45E+05 | 4.22E-02 |
| 1C11_H3.267_L3 | XenD22122 | XenD17482 | Y34F | - | 4.88E-08 | 4.38E+05 | 2.14E-02 |
| 1C11_H3.268_L3 | XenD22123 | XenD17482 | Y34H | - | 6.76E-08 | 2.63E+05 | 1.78E-02 |

Figure 105B

| Variant Name | HC XenD | LC XenD | VH Variants | VL Variants | K$_D$ (M) | k$_a$ (1/Ms) | k$_d$ (1/s) |
|---|---|---|---|---|---|---|---|
| 1C11_H3.269_L3 | XenD22124 | XenD17482 | Y34L | - | 1.03E-07 | 4.99E+05 | 5.14E-02 |
| 1C11_H3.270_L3 | XenD22125 | XenD17482 | Y34W | - | 6.17E-08 | 4.47E+05 | 2.76E-02 |
| 1C11_H3.271_L3 | XenD22126 | XenD17482 | G35T | - | | | |
| 1C11_H3.272_L3 | XenD22127 | XenD17482 | G35Q | - | | | |
| 1C11_H3.273_L3 | XenD22128 | XenD17482 | M36L | - | 4.82E-08 | 4.15E+05 | 2.00E-02 |
| 1C11_H3.274_L3 | XenD22129 | XenD17482 | V39L | - | 4.14E-08 | 3.21E+05 | 1.33E-02 |
| 1C11_H3.275_L3 | XenD22130 | XenD17482 | V39T | - | | | |
| 1C11_H3.276_L3 | XenD22131 | XenD17482 | V39F | - | 1.42E-07 | 4.07E+05 | 5.76E-02 |
| 1C11_H3.277_L3 | XenD22132 | XenD17482 | G51T | - | | | |
| 1C11_H3.278_L3 | XenD22133 | XenD17482 | G51D | - | | | |
| 1C11_H3.279_L3 | XenD22134 | XenD17482 | G51Q | - | | | |
| 1C11_H3.280_L3 | XenD22135 | XenD17482 | G51E | - | | | |
| 1C11_H3.281_L3 | XenD22136 | XenD17482 | W52F | - | 2.64E-07 | 9.36E+05 | 2.47E-01 |
| 1C11_H3.282_L3 | XenD22137 | XenD17482 | W52H | - | | | |
| 1C11_H3.283_L3 | XenD22138 | XenD17482 | N54Q | - | 2.10E-07 | 6.90E+05 | 1.45E-01 |
| 1C11_H3.284_L3 | XenD22139 | XenD17482 | N54E | - | 1.06E-07 | 1.66E+06 | 1.75E-01 |
| 1C11_H3.285_L3 | XenD22140 | XenD17482 | N54H | - | 2.10E-07 | 1.17E+06 | 2.45E-01 |
| 1C11_H3.286_L3 | XenD22141 | XenD17482 | N54S | - | 1.66E-07 | 7.93E+05 | 1.32E-01 |
| 1C11_H3.287_L3 | XenD22142 | XenD17482 | Y56F | - | 5.24E-08 | 4.32E+05 | 2.26E-02 |
| 1C11_H3.288_L3 | XenD22143 | XenD17482 | Y56H | - | 2.05E-08 | 3.45E+05 | 7.08E-03 |
| 1C11_H3.289_L3 | XenD22144 | XenD17482 | Y56L | - | 9.79E-08 | 3.36E+05 | 3.29E-02 |
| 1C11_H3.290_L3 | XenD22145 | XenD17482 | Y56W | - | 8.91E-08 | 3.37E+05 | 3.00E-02 |
| 1C11_H3.291_L3 | XenD22146 | XenD17482 | T59V | - | 5.44E-08 | 4.71E+05 | 2.56E-02 |
| 1C11_H3.292_L3 | XenD22147 | XenD17482 | T59S | - | 3.16E-08 | 3.08E+05 | 9.72E-03 |
| 1C11_H3.293_L3 | XenD22148 | XenD17482 | T59A | - | 4.33E-08 | 3.67E+05 | 1.59E-02 |
| 1C11_H3.294_L3 | XenD22149 | XenD17482 | T59I | - | 1.53E-07 | 3.40E+05 | 5.22E-02 |
| 1C11_H3.295_L3 | XenD22150 | XenD17482 | E61Q | - | 6.46E-08 | 3.06E+05 | 1.98E-02 |
| 1C11_H3.296_L3 | XenD22151 | XenD17482 | E61K | - | 1.20E-07 | 2.01E+05 | 2.42E-02 |
| 1C11_H3.297_L3 | XenD22152 | XenD17482 | Y110F | - | 3.99E-08 | 3.68E+05 | 1.47E-02 |

Figure 105C

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3.298_L3 | XenD22153 | XenD17482 | Y110Q | - | 4.00E-08 | 3.93E+05 | 1.57E-02 |
| 1C11_H3.299_L3 | XenD22154 | XenD17482 | Y110H | - | 4.16E-08 | 4.67E+05 | 1.94E-02 |
| 1C11_H3.300_L3 | XenD22155 | XenD17482 | Y110R | - | 2.99E-08 | 3.00E+05 | 8.98E-03 |
| 1C11_H3.301_L3 | XenD22156 | XenD17482 | Y110K | - | 7.04E-08 | 4.22E+05 | 2.97E-02 |
| 1C11_H3.302_L3 | XenD22157 | XenD17482 | Y111W | - | 4.23E-07 | 2.37E+05 | 1.00E-01 |
| 1C11_H3.303_L3 | XenD22158 | XenD17482 | Y111F | - | 1.37E-08 | 2.67E+05 | 3.66E-03 |
| 1C11_H3.304_L3 | XenD22159 | XenD17482 | G112A | - | 2.98E-07 | 3.29E+05 | 9.81E-02 |
| 1C11_H3.305_L3 | XenD22160 | XenD17482 | G112S | - | 7.23E-07 | 1.29E+05 | 9.35E-02 |
| 1C11_H3.306_L3 | XenD22161 | XenD17482 | Y116F | - | 3.62E-08 | 3.34E+05 | 1.21E-02 |
| 1C11_H3.307_L3 | XenD22162 | XenD17482 | Y116W | - | 6.87E-08 | 2.99E+05 | 2.05E-02 |
| 1C11_H3_L3.149 | XenD17478 | XenD22163 | - | H31Y | 5.36E-09 | 3.71E+05 | 1.99E-03 |
| 1C11_H3_L3.150 | XenD17478 | XenD22164 | - | H31Q | 1.64E-06 | 1.89E+05 | 3.11E-01 |
| 1C11_H3_L3.151 | XenD17478 | XenD22165 | - | H31D | 1.94E-06 | 1.39E+05 | 2.69E-01 |
| 1C11_H3_L3.152 | XenD17478 | XenD22166 | - | H31F | 2.88E-09 | 4.05E+05 | 1.17E-03 |
| 1C11_H3_L3.153 | XenD17478 | XenD22167 | - | H31T | 2.71E-07 | 1.22E+06 | 3.30E-01 |
| 1C11_H3_L3.154 | XenD17478 | XenD22168 | - | H31K | 8.36E-08 | 3.83E+06 | 3.20E-01 |
| 1C11_H3_L3.155 | XenD17478 | XenD22169 | - | S32T | 7.09E-08 | 2.95E+05 | 2.09E-02 |
| 1C11_H3_L3.156 | XenD17478 | XenD22170 | - | S32A | 4.05E-08 | 3.78E+05 | 1.53E-02 |
| 1C11_H3_L3.157 | XenD17478 | XenD22171 | - | S32Q | 7.70E-08 | 2.89E+05 | 2.22E-02 |
| 1C11_H3_L3.158 | XenD17478 | XenD22172 | - | S32G | 4.47E-08 | 2.52E+05 | 1.13E-02 |
| 1C11_H3_L3.159 | XenD17478 | XenD22173 | - | S32V | 4.54E-08 | 3.28E+05 | 1.49E-02 |
| 1C11_H3_L3.160 | XenD17478 | XenD22174 | - | N33H | 2.46E-08 | 7.40E+05 | 1.82E-02 |
| 1C11_H3_L3.161 | XenD17478 | XenD22175 | - | N33E | 2.51E-08 | 8.32E+05 | 2.09E-02 |
| 1C11_H3_L3.162 | XenD17478 | XenD22176 | - | N33S | 5.26E-08 | 4.53E+05 | 2.38E-02 |
| 1C11_H3_L3.163 | XenD17478 | XenD22177 | - | N33R | 9.95E-08 | 5.83E+05 | 5.80E-02 |
| 1C11_H3_L3.164 | XenD17478 | XenD22178 | - | N33L | 3.48E-08 | 7.39E+05 | 2.57E-02 |
| 1C11_H3_L3.165 | XenD17478 | XenD22179 | - | G34A | 3.22E-08 | 3.04E+05 | 9.76E-03 |
| 1C11_H3_L3.166 | XenD17478 | XenD22180 | - | G34S | 1.88E-08 | 4.56E+05 | 8.57E-03 |
| 1C11_H3_L3.167 | XenD17478 | XenD22181 | - | G34T | 2.52E-08 | 4.26E+05 | 1.07E-02 |

Figure 105D

| Variant Name | HC XenD | LC XenD | VH Variants | VL Variants | K$_D$ (M) | k$_a$ (1/Ms) | k$_d$ (1/s) |
|---|---|---|---|---|---|---|---|
| 1C11_H3_L3.168 | XenD17478 | XenD22182 | - | G34Q | 1.22E-08 | 4.73E+05 | 5.75E-03 |
| 1C11_H3_L3.169 | XenD17478 | XenD22183 | - | N35D | 4.98E-08 | 3.34E+05 | 1.66E-02 |
| 1C11_H3_L3.170 | XenD17478 | XenD22184 | - | N35H | 3.64E-08 | 3.67E+05 | 1.34E-02 |
| 1C11_H3_L3.171 | XenD17478 | XenD22185 | - | N35E | 5.63E-08 | 3.60E+05 | 2.03E-02 |
| 1C11_H3_L3.172 | XenD17478 | XenD22186 | - | N35R | 3.66E-08 | 2.60E+05 | 9.49E-03 |
| 1C11_H3_L3.173 | XenD17478 | XenD22187 | - | Y38F | 2.69E-07 | 4.99E+05 | 1.34E-01 |
| 1C11_H3_L3.174 | XenD17478 | XenD22188 | - | Y38H | 1.22E-07 | 3.68E+06 | 4.49E-01 |
| 1C11_H3_L3.175 | XenD17478 | XenD22189 | - | Y38L | | | |
| 1C11_H3_L3.176 | XenD17478 | XenD22190 | - | Y38W | 1.90E-06 | 2.95E+05 | 5.61E-01 |
| 1C11_H3_L3.177 | XenD17478 | XenD22191 | - | Y38Q | | | |
| 1C11_H3_L3.178 | XenD17478 | XenD22192 | - | Y55F | 5.59E-08 | 3.80E+05 | 2.13E-02 |
| 1C11_H3_L3.179 | XenD17478 | XenD22193 | - | Y55H | 7.74E-08 | 3.17E+05 | 2.46E-02 |
| 1C11_H3_L3.180 | XenD17478 | XenD22194 | - | Y55L | 5.86E-09 | 8.21E+05 | 4.81E-03 |
| 1C11_H3_L3.181 | XenD17478 | XenD22195 | - | Y55W | 1.12E-07 | 5.20E+05 | 5.83E-02 |
| 1C11_H3_L3.182 | XenD17478 | XenD22196 | - | Y55Q | 1.07E-07 | 3.95E+05 | 4.23E-02 |
| 1C11_H3_L3.183 | XenD17478 | XenD22197 | - | V57I | 4.03E-08 | 3.76E+05 | 1.51E-02 |
| 1C11_H3_L3.184 | XenD17478 | XenD22198 | - | V57L | 4.31E-08 | 4.10E+05 | 1.77E-02 |
| 1C11_H3_L3.185 | XenD17478 | XenD22199 | - | V57S | 4.78E-08 | 3.69E+05 | 1.76E-02 |
| 1C11_H3_L3.186 | XenD17478 | XenD22200 | - | N59D | 3.45E-08 | 4.04E+05 | 1.40E-02 |
| 1C11_H3_L3.187 | XenD17478 | XenD22201 | - | N59H | 6.37E-08 | 3.30E+05 | 2.10E-02 |
| 1C11_H3_L3.188 | XenD17478 | XenD22202 | - | N59E | 6.21E-08 | 4.35E+05 | 2.70E-02 |
| 1C11_H3_L3.189 | XenD17478 | XenD22203 | - | N59R | 1.27E-07 | 3.52E+05 | 4.46E-02 |
| 1C11_H3_L3.190 | XenD17478 | XenD22204 | - | F95M | 6.64E-08 | 3.37E+05 | 2.24E-02 |
| 1C11_H3_L3.191 | XenD17478 | XenD22205 | - | F95E | 4.91E-08 | 5.92E+05 | 2.91E-02 |
| 1C11_H3_L3.192 | XenD17478 | XenD22206 | - | G97A | 1.48E-07 | 3.79E+05 | 5.60E-02 |
| 1C11_H3_L3.193 | XenD17478 | XenD22207 | - | G97S | 2.63E-07 | 3.60E+05 | 9.47E-02 |
| 1C11_H3_L3.194 | XenD17478 | XenD22208 | - | G97D | 4.62E-08 | 4.49E+05 | 2.07E-02 |
| 1C11_H3_L3.195 | XenD17478 | XenD22209 | - | G97T | 3.45E-06 | 6.12E+04 | 2.11E-01 |
| 1C11_H3_L3.196 | XenD17478 | XenD22210 | - | G97Q | 1.27E-07 | 3.19E+05 | 4.05E-02 |

Figure 105E

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3_L3.197 | XenD17478 | XenD22211 | - | G97H | | | |
| 1C11_H3_L3.198 | XenD17478 | XenD22212 | - | G97L | 9.47E-08 | 8.29E+05 | 7.85E-02 |
| 1C11_H3_L3.199 | XenD17478 | XenD22213 | - | G97R | | | |
| 1C11_H3_L3.200 | XenD17478 | XenD22214 | - | G97F | | | |
| 1C11_H3_L3.201 | XenD17478 | XenD22215 | - | S98T | 5.22E-08 | 3.05E+05 | 1.59E-02 |
| 1C11_H3_L3.202 | XenD17478 | XenD22216 | - | S98A | 1.99E-08 | 3.89E+05 | 7.76E-03 |
| 1C11_H3_L3.203 | XenD17478 | XenD22217 | - | S98Q | 3.14E-08 | 6.06E+05 | 1.91E-02 |
| 1C11_H3_L3.204 | XenD17478 | XenD22218 | - | S98V | 1.28E-08 | 4.92E+05 | 6.30E-03 |
| 1C11_H3_L3.205 | XenD17478 | XenD22219 | - | H99Y | 5.46E-08 | 3.89E+05 | 2.13E-02 |
| 1C11_H3_L3.206 | XenD17478 | XenD22220 | - | H99Q | 4.57E-08 | 2.75E+05 | 1.26E-02 |
| 1C11_H3_L3.207 | XenD17478 | XenD22221 | - | H99D | 3.48E-08 | 3.48E+05 | 1.21E-02 |
| 1C11_H3_L3.208 | XenD17478 | XenD22222 | - | H99F | 5.16E-08 | 3.91E+05 | 2.02E-02 |
| 1C11_H3_L3.209 | XenD17478 | XenD22223 | - | H99T | 2.93E-08 | 4.26E+05 | 1.25E-02 |

Figure 106

| Variant Name | HC XenD | LC XenD | VH Variants | VL Variants | $K_D$ (M) | $k_a$ (1/Ms) | $k_d$ (1/s) |
|---|---|---|---|---|---|---|---|
| 1C11_H3.244_L3 | XenD22099 | XenD17482 | G26T | - | 6.48E-08 | 4.54E+05 | 2.94E-02 |
| 1C11_H3.249_L3 | XenD22104 | XenD17482 | Y27D | - | 6.00E-08 | 4.91E+05 | 2.95E-02 |
| 1C11_H3.250_L3 | XenD22105 | XenD17482 | Y27K | - | 3.16E-07 | 3.65E+05 | 1.15E-01 |
| 1C11_H3.256_L3 | XenD22111 | XenD17482 | F29W | - | 2.95E-08 | 3.07E+05 | 9.05E-03 |
| 1C11_H3.258_L3 | XenD22113 | XenD17482 | T30V | - | 2.53E-08 | 4.16E+05 | 1.05E-02 |
| 1C11_H3.288_L3 | XenD22143 | XenD17482 | Y56H | - | 1.95E-08 | 4.18E+05 | 8.16E-03 |
| 1C11_H3.292_L3 | XenD22147 | XenD17482 | T59S | - | 2.02E-08 | 3.34E+05 | 6.75E-03 |
| 1C11_H3.303_L3 | XenD22158 | XenD17482 | Y111F | - | 1.48E-08 | 3.60E+05 | 5.34E-03 |
| 1C11_H3_L3.149 | XenD17478 | XenD22163 | - | H31Y | 7.35E-09 | 6.55E+05 | 4.82E-03 |
| 1C11_H3_L3.152 | XenD17478 | XenD22166 | - | H31F | 6.27E-09 | 4.55E+05 | 2.85E-03 |
| 1C11_H3_L3.160 | XenD17478 | XenD22174 | - | N33H | 4.29E-07 | 1.95E+05 | 8.37E-02 |
| 1C11_H3_L3.161 | XenD17478 | XenD22175 | - | N33E | 3.33E-07 | 3.51E+05 | 1.17E-01 |
| 1C11_H3_L3.166 | XenD17478 | XenD22180 | - | G34S | 3.14E-08 | 4.25E+05 | 1.34E-02 |
| 1C11_H3_L3.168 | XenD17478 | XenD22182 | - | G34Q | 3.18E-08 | 4.57E+05 | 1.45E-02 |
| 1C11_H3_L3.180 | XenD17478 | XenD22194 | - | Y55L | 1.14E-07 | 3.64E+05 | 4.13E-02 |
| 1C11_H3_L3.186 | XenD17478 | XenD22200 | - | N59D | 6.14E-08 | 4.25E+05 | 2.61E-02 |
| 1C11_H3_L3.191 | XenD17478 | XenD22205 | - | F95E | 5.89E-08 | 4.40E+05 | 2.59E-02 |
| 1C11_H3_L3.194 | XenD17478 | XenD22208 | - | G97D | 1.04E-07 | 2.44E+05 | 2.54E-02 |
| 1C11_H3_L3.202 | XenD17478 | XenD22216 | - | S98A | 2.64E-08 | 3.69E+05 | 9.74E-03 |
| 1C11_H3_L3.204 | XenD17478 | XenD22218 | - | S98V | 2.97E-08 | 3.86E+05 | 1.15E-02 |
| 1C11_H3_L3.207 | XenD17478 | XenD22221 | - | H99D | 3.14E-08 | 2.94E+05 | 9.23E-03 |

Figure 107

| XENP | Variant | human PD-1 $K_D$ (M) | cyno PD-1 $K_D$ (M) |
|---|---|---|---|
| 21461 | Pembrolizumab_H0L0 | 4.48E-09 | 1.17E-09 |
| 16432 | Nivolumab_H0L0 | 4.46E-09 | 4.09E-09 |
| 21575 | 1C11[PD-1]_H0L0 | 8.65E-09 | 1.39E-08 |
| 22553 | 1C11[PD-1]_H3L3 | 8.35E-09 | 1.23E-08 |
| 25842 | 1C11[PD-1]_H3.241_L3.92 | 7.74E-09 | 1.30E-08 |
| 26917 | 1C11[PD-1]_H3.244_L3 | 1.19E-08 | 1.94E-08 |
| 26322 | 1C11[PD-1]_H3.59_L3.38 | 3.77E-09 | 7.73E-09 |
| 26926 | 1C11[PD-1]_H3_L3.152 | 1.69E-09 | 2.33E-09 |
| 26940 | 1C11[PD-1]_H3.303_L3.152 | 1.31E-09 | 3.00E-09 |

Figure 109A

>XENP29159 human_IL15Ra(sushi)_(GGGGS)5-human_IL15(N4D/N65D;single-chain)-1C11[PD-1]_H3.329_L3.220_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S-(SEQ ID NO: 886)

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.329_IgG1_PVA_/S267K/S364K/E357Q-(SEQ ID NO: 887)

QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.220 (SEQ ID NO: 888)

DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

>XENP29160 human_IL15Ra(sushi)_(GGGGS)5-human_IL15(N4D/N65D;single-chain)-1C11[PD-1]_H3.303_L3.152_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_IgG1_Fc(216)_IgG1_pI(-)_Isosteric_A_C220S/PVA_/S267K/L368D/K370S-(SEQ ID NO: 889)

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.303_IgG1_PVA_/S267K/S364K/E357Q-(SEQ ID NO: 890)

QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.152-(SEQ ID NO: 891)

DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 109B

> human_IL15Ra(sushi)_(GGGGS)5-human_IL15(N4D/N65D;single-chain)-1C11[PD-1]_ H3.234_L3.144_IgG1_Fc(216)_IgG1_pI(-)_Isosteric_A_C220S/PVA_/S267K/L368D/K370S- IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S-(SEQ ID NO: 892)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.234_IgG1_PVA_/S267K/S364K/E357Q-(SEQ ID NO: 893)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.144 (SEQ ID NO: 894)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(N4D/N65D;single-chain)-1C11[PD-1]_ H3.240_L3.148_IgG1_Fc(216)_IgG1_pI(-)_Isosteric_A_C220S/PVA_/S267K/L368D/K370S- IgG1_PVA_/S267K/S364K/E357Q

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S-(SEQ ID NO: 895)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.240_IgG1_PVA_/S267K/S364K/E357Q-(SEQ ID NO: 896)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.148-(SEQ ID NO: 897)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 109C

>human_IL15Ra(sushi)_(GGGGS)5-human_IL15(N4D/N65D;single-chain)-1C11[PD-1]_
H3.241_L3.148_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S (SEQ ID NO: 898)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/<u>NWVDVISDLKKIEDLIQSMHIDATLYTESDVHPSCKVTAMKCFLLELQVISLESGDAS</u>
<u>IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_ H3.241_IgG1_PVA_/S267K/S364K/E357Q-(SEQ ID NO: 899)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_ L3.148-(SEQ ID NO: 900)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC >human_IL15Ra(sushi)_(GGGGS)5-human_IL15(N4D/N65D;single-chain)-1C11[PD-1]_
H3.241_L3.92_IgG1_Fc(216)_IgG1_pI(-)_Isosteric_A_C220S/PVA_/S267K/L368D/K370S-
IgG1_PVA_/S267K/S364K/E357Q Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S-(SEQ ID NO: 901)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/<u>NWVDVISDLKKIEDLIQSMHIDATLYTESDVHPSCKVTAMKCFLLELQVISLESGDAS</u>
<u>IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_ H3.241_IgG1_PVA_/S267K/S364K/E357Q-(SEQ ID NO: 902)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_ L3.92-(SEQ ID NO: 903)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 109D

> human_IL15Ra(sushi)_(GGGGS)5-human_IL15(N4D/N65D;single-chain)-1C11[PD-1]_ H3.328_L3.152_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S-(SEQ ID NO: 904)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_ H3.328_IgG1_PVA_/S267K/S364K/E357Q-(SEQ ID NO: 905)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_ L3.152-(SEQ ID NO: 906)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 119

>XENP22853 human_IL15_(GGGGS)1-human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP22853 Chain 1 - human_IL15_(GGGGS)1-Fc(216)_IgG1_pI(-
)_Isosteric_A_C220S/PVA_/S267K/L368D/K370S/M428L/N434S (SEQ ID NO: 907)
NWVNVISDLKKIEDLIQSMHIDATLYTESDVHPSCKVTAMKCFLLELQVISLESGDASIHDTVENLII
LANNSLSSNGNVTESGCKECEELEEKNIKEFLQSFVHIVQMFINTS/GGGGS/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVLHEALHSH
YTQKSLSLSPGK XENP22853 Chain 2 - human_IL15Ra(Sushi)_(GGGGS)1-
Fc(216)_IgG1_C220S/PVA_/S267K/S364K/E357Q/M428L/N434S-(SEQ ID NO: 908)
ITCPPPMSVEHADIWVKSYSLYSRERYICNSGFKRKAGTSSLTECVLNKATNVAHWTTPSLKCIR/GG
GGS/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK

Figure 120

>XENP24113 human_IL15_N4D/N65D_(GGGGS)1-
human_IL15Ra(Sushi)_(GGGGS)1_Fc(216)_IgG1_pI(-
)_Isosteric_A_C220S/PVA_/S267K/L368D/K370S/M428L/N434S-
Fc(216)_IgG1_C220S/PVA_/S267K/S364K/E357Q/M428L/N434S XENP24113 Chain 1 - human_IL15_N4D/N65D_(GGGGS)1-Fc(216)_IgG1_pI(-
)_Isosteric_A_C220S/PVA_/S267K/L368D/K370S/M428L/N434S-(SEQ ID NO: 909)
NWVDVISDLKKIEDLIQSMHIDATLYTESDVHPSCKVTAMKCFLLELQVISLESGDASIHDTVEDLII
LANNSLSSNGNVTESGCKECEELEEKNIKEFLQSFVHIVQMFINTS/GGGGS/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVLHEALHSH
YTQKSLSLSPGK XENP24113 Chain 2 - human_IL15Ra(Sushi)_(GGGGS)1-
Fc(216)_IgG1_C220S/PVA_/S267K/S364K/E357Q/M428L/N434S-(SEQ ID NO: 910)
ITCPPPMSVEHADIWVKSYSLYSRERYICNSGFKRKAGTSSLTECVLNKATNVAHWTTPSLKCIR/GG
GGS/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK

Figure 121

>XENP24294 human_IL15Ra(sushi)_(GGGGS)5-human_IL15_N4D/N65D_(single-Chain)-empty-Fc_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S XENP24294 Chain 1 - human_IL15Ra(sushi)_(GGGGS)5-human_IL15_N4D/N65D_(single-Chain)-Fc(216)_IgG1_pI(-)_Isosteric_A_C220S/PVA_/S267K/L368D/K370S/M428L/N434S-(SEQ ID NO: 911)
ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVDVISDLKKIEDLIQSMHIDATLYTESDVHPSCKVTAMKCFL
LELQVISLESGDASIHDTVEDLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVLHEALHSHYTQKSLSLSPGK XENP24294 Chain 2 - empty-Fc(216)_IgG1_C220S/PVA_/S267K/S364K/E357Q/M428L/N434S-(SEQ ID NO: 912)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVLHEALHSHYTQKSLSLSPGK

Figure 122

>XENP24306 human_IL15_D30N/E64Q/N65D_(GGGGS)1-human_IL15Ra(Sushi)_(GGGGS)1_Fc(216)_IgG1_pI(-)_Isosteric_A_C220S/PVA_/S267K/L368D/K370S/M428L/N434S-Fc(216)_IgG1_C220S/PVA_/S267K/S364K/E357Q/M428L/N434S XENP24306 Chain 1 - human_IL15_D30N/E64Q/N65D_(GGGGS)1-Fc(216)_IgG1_pI(-)_Isosteric_A_C220S/PVA_/S267K/L368D/K370S/M428L/N434S-(SEQ ID NO: 913)
NWVNVISDLKKIEDLIQSMHIDATLYTESNVHPSCKVTAMKCFLLELQVISLESGDASIHDTVQDLII
LANNSLSSNGNVTESGCKECEELEEKNIKEFLQSFVHIVQMFINTS/GGGGS/EPKSSDKTHTCPPCP
APPVAGPSVFLFPPKPKDTLMISRTPEVTCVVVDVKHEDPEVKFNWYVDGVEVHNAKTKPREEEYNST
YRVVSVLTVLHQDWLNGKEYKCKVSNKALPAPIEKTISKAKGQPREPQVYTLPPSREEMTKNQVSLTC
DVSGFYPSDIAVEWESDGQPENNYKTTPPVLDSDGSFFLYSKLTVDKSRWEQGDVFSCSVLHEALHSH
YTQKSLSLSPGK XENP24306 Chain 2 - human_IL15Ra(Sushi)_(GGGGS)1-Fc(216)_IgG1_C220S/PVA_/S267K/S364K/E357Q/M428L/N434S-(SEQ ID NO: 914)
ITCPPPMSVEHADIWVKSYSLYSRERYICNSGFKRKAGTSSLTECVLNKATNVAHWTTPSLKCIR/GG
GGS/EPKSSDKTHTCPPCPAPPVAGPSVFLFPPKPKDTLMISRTPEVTCVVVDVKHEDPEVKFNWYVD
GVEVHNAKTKPREEQYNSTYRVVSVLTVLHQDWLNGKEYKCKVSNKALPAPIEKTISKAKGQPREPQV
YTLPPSREQMTKNQVKLTCLVKGFYPSDIAVEWESNGQPENNYKTTPPVLDSDGSFFLYSKLTVDKSR
WQQGNVFSCSVLHEALHSHYTQKSLSLSPGK

Figure 124A

>XENP21993 human_IL15Ra(sushi)_(GGGGS)5-human_IL15(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15(single-chain)_Fc(216)_IgG1_pI(-
)_Isosteric_A_C220S/PVA_/S267K/L368D/K370S (SEQ ID NO: 915)
ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVNVISDLKKIEDLIQSMHIDATLYTESDVHPSCKVTAMKCFL
LELQVISLESGDASIHDTVENLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK Chain 2 - empty_Fc(216)_IgG1_C220S/PVA_/S267K/S364K/E357Q (SEQ ID NO: 916)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK >XENP24050 human_IL15Ra(sushi)_(GGGGS)5-human_IL15_N4D/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_N4D/N65D_(single-
chain)_Fc(216)_IgG1_pI(-)_Isosteric_A_C220S/PVA_/S267K/L368D/K370S (SEQ ID NO: 917)
ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVDVISDLKKIEDLIQSMHIDATLYTESDVHPSCKVTAMKCFL
LELQVISLESGDASIHDTVEDLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK Chain 2 - empty_Fc(216)_IgG1_C220S/PVA_/S267K/S364K/E357Q (SEQ ID NO: 918)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Figure 124B

>XENP29281 human_IL15Ra(sushi)_(GGGGS)5-human_IL15_D30N_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_D30N_(single-chain)_Fc(216)_IgG1_pI(-
)_Isosteric_A_C220S/PVA_/S267K/L368D/K370S (SEQ ID NO: 919)
ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVNVISDLKKIEDLIQSMHIDATLYTESNVHPSCKVTAMKCFL
LELQVISLESGDASIHDTVENLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK Chain 2 - empty_Fc(216)_IgG1_C220S/PVA_/S267K/S364K/E357Q (SEQ ID NO: 920)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK >XENP29285 human_IL15Ra(sushi)_(GGGGS)5-human_IL15_D30N/N65D_(single-chain)-empty-
Fc_Fc(216)_IgG1_pI(-)_Isosteric_A_C220S/PVA_/S267K/L368D/K370S-
Fc(216)_IgG1_C220S/PVA_/S267K/S364K/E357Q Chain 1 - human_IL15Ra(sushi)_(GGGGS)5-human_IL15_D30N/N65D_(single-
chain)_Fc(216)_IgG1_pI(-)_Isosteric_A_C220S/PVA_/S267K/L368D/K370S (SEQ ID NO: 921)
ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVNVISDLKKIEDLIQSMHIDATLYTESNVHPSCKVTAMKCFL
LELQVISLESGDASIHDTVEDLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK Chain 2 - empty_Fc(216)_IgG1_C220S/PVA_/S267K/S364K/E357Q (SEQ ID NO: 922)
EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Figure 124C

>XENP29286 human_IL15Ra(sushi)_(GGGGS)5-human_IL15_D30N/E64Q/N65D_(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL15Ra(sushi)_(GGGGS)5-human_IL15_D30N/E64Q/N65D_(single-chain)_Fc(216)_IgG1_pI(-)_Isosteric_A_C220S/PVA_/S267K/L368D/K370S (SEQ ID NO: 923)

ITCPPPMSVEHADIWVKSYSLYSRERYICNSGFKRKAGTSSLTECVLNKATNVAHWTTPSLKCIR/GG
GGSGGGGSGGGGSGGGGSGGGGS/NWVNVISDLKKIEDLIQSMHIDATLYTESNVHPSCKVTAMKCFL
LELQVISLESGDASIHDTVQDLIILANNSLSSNGNVTESGCKECEELEEKNIKEFLQSFVHIVQMFIN
TS/EPKSSDKTHTCPPCPAPPVAGPSVFLFPPKPKDTLMISRTPEVTCVVVDVKHEDPEVKFNWYVDG
VEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRW
EQGDVFSCSVMHEALHNHYTQKSLSLSPGK

Chain 2 - empty_Fc(216)_IgG1_C220S/PVA_/S267K/S364K/E357Q (SEQ ID NO: 924)

EPKSSDKTHTCPPCPAPPVAGPSVFLFPPKPKDTLMISRTPEVTCVVVDVKHEDPEVKFNWYVDGVEV
HNAKTKPREEQYNSTYRVVSVLTVLHQDWLNGKEYKCKVSNKALPAPIEKTISKAKGQPREPQVYTLP
PSREQMTKNQVKLTCLVKGFYPSDIAVEWESNGQPENNYKTTPPVLDSDGSFFLYSKLTVDKSRWQQG
NVFSCSVMHEALHNHYTQKSLSLSPGK

Figure 126A

>XENP29482 human_IL15Ra(sushi)_(GGGGS)5-human_IL15(D30N/N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 925)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/<u>NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_H3_IgG1_PVA_/S267K/S364K/E357Q (SEQ ID NO: 926)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_L3 (SEQ ID NO: 1216)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_H3.329_L3.220_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 927)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/<u>NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_H3.329_IgG1_PVA_/S267K/S364K/E357Q (SEQ ID NO: 928)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_L3.220 (SEQ ID NO: 929)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 126B

> human_IL15Ra(sushi)_(GGGGS)5-human_IL15(D30N/N65D;single-chain)-1C11[PD-1]_H3.303_L3.152_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_IgG1_Fc(216)_IgG1_pI(-)_Isosteric_A_C220S/PVA_/S267K/L368D/K370S (SEQ ID NO: 930)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.303_IgG1_PVA_/S267K/S364K/E357Q (SEQ ID NO: 931)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.152 (SEQ ID NO: 932)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_H3.234_L3.144_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 933)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.234_IgG1_PVA_/S267K/S364K/E357Q (SEQ ID NO: 934)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.144 (SEQ ID NO: 935)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 126C

> human_IL15Ra(sushi)_(GGGGS)5-human_IL15(D30N/N65D;single-chain)-1C11[PD-1]_
H3.240_L3.148_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 936)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.240_IgG1_PVA_/S267K/S364K/E357Q (SEQ ID NO: 937)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.148 (SEQ ID NO: 938)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_
H3.241_L3.148_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 939)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.241_IgG1_PVA_/S267K/S364K/E357Q (SEQ ID NO: 940)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.148 (SEQ ID NO: 941)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 126D

\> human_IL15Ra(sushi)_(GGGGS)5-human_IL15(D30N/N65D;single-chain)-1C11[PD-1]_
H3.241_L3.92_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 942)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.241_IgG1_PVA_/S267K/S364K/E357Q (SEQ ID NO: 943)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.92 (SEQ ID NO: 944)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC \> human_IL15Ra(sushi)_(GGGGS)5-human_IL15(D30N/N65D;single-chain)-1C11[PD-1]_
H3.328_L3.152_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S (SEQ ID NO: 945)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.328_IgG1_PVA_/S267K/S364K/E357Q (SEQ ID NO: 946)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.152 (SEQ ID NO: 947)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 127A

> human_IL15Ra(sushi)_(GGGGS)5-human_IL15(D30N/E64Q/N65D;single-chain)-1C11[PD-1]_H3L3_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 948)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_H3_IgG1_PVA_/S267K/S364K/E357Q (SEQ ID NO: 949)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_L3 (SEQ ID NO: 950)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_H3.329_L3.220_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 951)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK Chain 2 - 1C11[PD-1]_H3.329_IgG1_PVA_/S267K/S364K/E357Q (SEQ ID NO: 952)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_L3.220 (SEQ ID NO: 953)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 127B

>human_IL15Ra(sushi)_(GGGGS)5-human_IL15(D30N/E64Q/N65D;single-chain)-1C11[PD-1]_H3.303_L3.152_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_IgG1_Fc(216)_IgG1_pI(-)_Isosteric_A_C220S/PVA_/S267K/L368D/K370S (SEQ ID NO: 954)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.303_IgG1_PVA_/S267K/S364K/E357Q (SEQ ID NO: 955)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.152 (SEQ ID NO: 956)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC >human_IL15Ra(sushi)_(GGGGS)5-human_IL15(D30N/E64Q/N65D;single-chain)-1C11[PD-1]_H3.234_L3.144_IgG1_Fc(216)_IgG1_pI(-)_Isosteric_A_C220S/PVA_/S267K/L368D/K370S-IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 957)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.234_IgG1_PVA_/S267K/S364K/E357Q (SEQ ID NO: 958)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.144 (SEQ ID NO: 959)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 127C

> human_IL15Ra(sushi)_(GGGGS)5-human_IL15(D30N/E64Q/N65D;single-chain)-1C11[PD-1]_
H3.240_L3.148_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 960)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.240_IgG1_PVA_/S267K/S364K/E357Q (SEQ ID NO: 961)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.148 (SEQ ID NO: 962)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_
H3.241_L3.148_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 963)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_ H3.241_IgG1_PVA_/S267K/S364K/E357Q (SEQ ID NO: 964)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_ L3.148 (SEQ ID NO: 965)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 127D

> human_IL15Ra(sushi)_(GGGGS)5-human_IL15(D30N/E64Q/N65D;single-chain)-1C11[PD-1]_
H3.241_L3.92_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 966)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.241_IgG1_PVA_/S267K/S364K/E357Q (SEQ ID NO: 967)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.92 (SEQ ID NO: 968)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_
H3.328_L3.152_IgG1_Fc(216)_IgG1_pI(-)_Isosteric_A_C220S/PVA_/S267K/L368D/K370S-
IgG1_PVA_/S267K/S364K/E357Q

Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 969)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - 1C11[PD-1]_H3.328_IgG1_PVA_/S267K/S364K/E357Q (SEQ ID NO: 970)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK

Chain 3 - 1C11[PD-1]_L3.152 (SEQ ID NO: 971)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128A

XENP025937human_IL15Ra(sushi)_(GGGGS)5-human_IL15(N4D/N65D;single-chain)-1C11[PD-1]_H3L3_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - 1C11[PD-1]_H3_ IgG1_PVA_/S267K/S364K/E357Q/M428L/N434S (SEQ ID NO: 972)
QIQLVQSGSELKKPGASVKVSCKASGYTFTHYGMNWVRQAPGQGLEWMGWINTYTGEPTYADGFTGRFVFSLDTSVSTAYLQISSLKAED
TAVYFCARDYYGSSPYWGQGTLVTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREQMTK
NQVKLTCLVKGFYPSDIAVEWESNGQPENNYKTTPPVLDSDGSFFLYSKLTVDKSRWQQGNVFSCSVLHEALHSHYTQKSLSLSPGK Chain2-human_IL15Ra(sushi)_(GGGGS)5-human_IL15(N4D/N65D;single-chain)_ Fc(216)_IgG1_pI(-)_Isosteric_A_C220S/PVA_/S267K/L368D/K370S/M428L/N434S (SEQ ID NO: 973)
ITCPPPMSVEHADIWVKSYSLYSRERYICNSGFKRKAGTSSLTECVLNKATNVAHWTTPSLKCIR/<u>GGGGSGGGGSGGGGSGGGGSGGGG
S</u>/NWVDVISDLKKIEDLIQSMHIDATLYTESDVHPSCKVTAMKCFLLELQVISLESGDASIHDTVEDLIILANNSLSSNGNVTESGCKEC
EELEEKNIKEFLQSFVHIVQMFINTS/EPKSSDKTHTCPPCPAPPVAGPSVFLFPPKPKDTLMISRTPEVTCVVVDVKHEDPEVKFNWYV
DGVEVHNAKTKPREEEYNSTYRVVSVLTVLHQDWLNGKEYKCKVSNKALPAPIEKTISKAKGQPREPQVYTLPPSREEMTKNQVSLTCDV
SGFYPSDIAVEWESDGQPENNYKTTPPVLDSDGSFFLYSKLTVDKSRWEQGDVFSCSVLHEALHSHYTQKSLSLSPGK Chain3-1C11[PD-1]_L3 (SEQ ID NO: 974)
DVLMTQSPDSLAVSLGERATINCKSSQSIVHSNGNTYLEWYQQKPGQSPKLLIYKVSNRFSGVPDRFSGSGSGTDFTLTISSLQAEDVAV
YYCFQGSHVPNTFGGGTKVEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC > human_IL15Ra(sushi)_(GGGGS)5-human_IL15(N4D/N65D;single-chain)-1C11[PD-1]_H3.329_L3.220_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S/M428L/N434S (SEQ ID NO: 975)
ITCPPPMSVEHADIWVKSYSLYSRERYICNSGFKRKAGTSSLTECVLNKATNVAHWTTPSLKCIR/<u>GGGGSGGGG
SGGGGSGGGGSGGGGS</u>/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_H3.329_IgG1_PVA_/S267K/S364K/E357Q/M428L/N434S (SEQ ID NO: 976)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_L3.220 (SEQ ID NO: 977)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128B

> human_IL15Ra(sushi)_(GGGGS)5-human_IL15(N4D/N65D;single-chain)-1C11[PD-1]_H3.303_L3.152_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(N4D/N65D;single-chain)_IgG1_Fc(216)_IgG1_pI(-)_Isosteric_A_C220S/PVA_/S267K/L368D/K370S/M428L/N434S (SEQ ID NO: 978)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.303_IgG1_PVA_/S267K/S364K/E357Q/M428L/N434S (SEQ ID NO: 979)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_L3.152 (SEQ ID NO: 980)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(N4D/N65D;single-chain)-1C11[PD-1]_H3.234_L3.144_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL15Ra(sushi)_(GGGGS)5-human_IL15(N4D/N65D;single-chain)_Fc(216)_IgG1_pI(-)_Isosteric_A_C220S/PVA_/S267K/L368D/K370S/M428L/N434S (SEQ ID NO: 981)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.234_IgG1_PVA_/S267K/S364K/E357Q/M428L/N434S (SEQ ID NO: 982)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_L3.144 (SEQ ID NO: 983)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128C

> human_IL15Ra(sushi)_(GGGGS)5-human_IL15(N4D/N65D;single-chain)-1C11[PD-1]_
H3.240_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S (SEQ ID NO: 984)**
<u>ITCPPPMSVEHADIWVKSYSLYSRERYICNSGFKRKAGTSSLTECVLNKATNVAHWTTPSLKCIR</u>/<u>GGGGSGGGG
SGGGGSGGGGSGGGGS</u>/<u>NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.240_IgG1_PVA_/S267K/S364K/E357Q/M428L/N434S (SEQ ID NO: 985)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 986)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(N4D/N65D;single-chain)-1C11[PD-1]_
H3.241_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S (SEQ ID NO: 987)**
<u>ITCPPPMSVEHADIWVKSYSLYSRERYICNSGFKRKAGTSSLTECVLNKATNVAHWTTPSLKCIR</u>/<u>GGGGSGGGG
SGGGGSGGGGSGGGGS</u>/<u>NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS</u>/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.241_IgG1_PVA_/S267K/S364K/E357Q/M428L/N434S (SEQ ID NO: 988)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 989)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128D

> human_IL15Ra(sushi)_(GGGGS)5-human_IL15(N4D/N65D;single-chain)-1C11[PD-1]_
H3.241_L3.92_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S (SEQ ID NO: 990)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.241_IgG1_PVA_/S267K/S364K/E357Q/M428L/N434S (SEQ ID NO: 991)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.92 (SEQ ID NO: 992)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(N4D/N65D;single-chain)-1C11[PD-1]_
H3.328_L3.152_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(N4D/N65D;single-chain)_Fc(216)_IgG1_pI(-
)_Isosteric_A_C220S/PVA_/S267K/L368D/K370S/M428L/N434S (SEQ ID NO: 993)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.328_IgG1_PVA_/S267K/S364K/E357Q/M428L/N434S (SEQ ID NO: 994)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.152 (SEQ ID NO: 995)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128E

>human_IL15Ra(sushi)_(GGGGS)5-human_IL15(D30N/N65D;single-chain)-1C11[PD-
1]_H3L3_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S (SEQ ID NO: 996)**
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3_IgG1_PVA_/S267K/S364K/E357Q/M428L/N434S (SEQ ID NO: 997)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_L3 (SEQ ID NO: 998)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC >human_IL15Ra(sushi)_(GGGGS)5-human_IL15(D30N/N65D;single-chain)-1C11[PD-
1]_H3.329_L3.220_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S (SEQ ID NO: 999)**
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.329_IgG1_PVA_/S267K/S364K/E357Q/M428L/N434S (SEQ ID NO: 1000)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_L3.220 (SEQ ID NO: 1001)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128F

> human_IL15Ra(sushi)_(GGGGS)5-human_IL15(D30N/N65D;single-chain)-1C11[PD-
1]_H3.303_L3.152_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/N65D;single-chain)_IgG1_Fc(216)_IgG1_pI(-
)_Isosteric_A_C220S/PVA_/S267K/L368D/K370S/M428L/N434S (SEQ ID NO: 1002)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_H3.303_IgG1_PVA_/S267K/S364K/E357Q/M428L/N434S (SEQ ID NO: 1003)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_L3.152 (SEQ ID NO: 1004)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_
H3.234_L3.144_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S (SEQ ID NO: 1005)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.234_IgG1_PVA_/S267K/S364K/E357Q/M428L/N434S (SEQ ID NO: 1006)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.144 (SEQ ID NO: 1007)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128G

> human_IL15Ra(sushi)_(GGGGS)5-human_IL15(D30N/N65D;single-chain)-1C11[PD-1]_
H3.240_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 1008)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.240_IgG1_PVA_/S267K/S364K/E357Q/M428L/N434S (SEQ ID NO: 1009)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 1010)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_
H3.241_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

Chain 1 - human_IL15Ra(sushi)_(GGGGS)5-human_IL15(D30N/N65D;single-chain)_Fc(216)_IgG1_pI(-)_Isosteric_A_C220S/PVA_/S267K/L368D/K370S/M428L/N434S (SEQ ID NO: 1011)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.241_IgG1_PVA_/S267K/S364K/E357Q/M428L/N434S (SEQ ID NO: 1012)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 1013)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128H

> human_IL15Ra(sushi)_(GGGGS)5-human_IL15(D30N/N65D;single-chain)-1C11[PD-1]_
H3.241_L3.92_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S (SEQ ID NO: 1014)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_ H3.241_IgG1_PVA_/S267K/S364K/E357Q/M428L/N434S (SEQ ID NO: 1015)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_ L3.92 (SEQ ID NO: 1016)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/N65D;single-chain)-1C11[PD-1]_
H3.328_L3.152_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S/M428L/N434S (SEQ ID NO: 1017)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_ H3.328_IgG1_PVA_/S267K/S364K/E357Q/M428L/N434S (SEQ ID NO: 1018)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_ L3.152 (SEQ ID NO: 1019)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128I

> human_IL15Ra(sushi)_(GGGGS)5-human_IL15(D30N/E64Q/N65D;single-chain)-1C11[PD-
1]_H3L3_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S/M428L/N434S (SEQ ID NO: 1020)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_H3_IgG1_PVA_/S267K/S364K/E357Q/M428L/N434S (SEQ ID NO: 1021)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_L3 (SEQ ID NO: 1022)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-
1]_H3.329_L3.220_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S/M428L/N434S (SEQ ID NO: 1023)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_H3.329_IgG1_PVA_/S267K/S364K/E357Q/M428L/N434S (SEQ ID NO: 1024)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_L3.220 (SEQ ID NO: 1025)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128J

> human_IL15Ra(sushi)_(GGGGS)5-human_IL15(D30N/E64Q/N65D;single-chain)-1C11[PD-1]_H3.303_L3.152_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/E64Q/N65D;single-chain)_IgG1_Fc(216)_IgG1_pI(-)_Isosteric_A_C220S/PVA_/S267K/L368D/K370S/M428L/N434S (SEQ ID NO: 1026)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_H3.303_IgG1_PVA_/S267K/S364K/E357Q/M428L/N434S (SEQ ID NO: 1027)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_L3.152 (SEQ ID NO: 1028)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_H3.234_L3.144_IgG1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S/M428L/N434S (SEQ ID NO: 1029)
ITCPPPMSVEHADIWVKSYSLYSRERYICNSGFKRKAGTSSLTECVLNKATNVAHWTTPSLKCIR/<u>GGGGSGGGG</u>
<u>SGGGGSGGGGSGGGGS</u>/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK Chain 2 - 1C11[PD-1]_ H3.234_IgG1_PVA_/S267K/S364K/E357Q/M428L/N434S (SEQ ID NO: 1030)
EVQLVQSGSELKKPGESVKVSCKASGYTFTHYGINWVRQPPGQGLEWMGWINTYTGEPYYAPGFQERFVFSLDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK Chain 3 - 1C11[PD-1]_ L3.144 (SEQ ID NO: 1031)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSHVPNTFGQGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128K

> human_IL15Ra(sushi)_(GGGGS)5-human_IL15(D30N/E64Q/N65D;single-chain)-1C11[PD-1]_
H3.240_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

Chain 1 - human_IL15Ra(sushi)_(GGGGS)5-human_IL15(D30N/E64Q/N65D;single-chain)_Fc(216)_IgG1_pI(- )_Isosteric_A_C220S/PVA_/S267K/L368D/K370S/M428L/N434S (SEQ ID NO: 1032)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.240_IgG1_PVA_/S267K/S364K/E357Q/M428L/N434S (SEQ ID NO: 1033)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 1034)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_
H3.241_L3.148_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

Chain 1 - human_IL15Ra(sushi)_(GGGGS)5-human_IL15(D30N/E64Q/N65D;single-chain)_Fc(216)_IgG1_pI(- )_Isosteric_A_C220S/PVA_/S267K/L368D/K370S/M428L/N434S (SEQ ID NO: 1035)
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.241_IgG1_PVA_/S267K/S364K/E357Q/M428L/N434S (SEQ ID NO: 1051)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.148 (SEQ ID NO: 1052)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 128L

> human_IL15Ra(sushi)_(GGGGS)5-human_IL15(D30N/E64Q/N65D;single-chain)-1C11[PD-1]_
H3.241_L3.92_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S/M428L/N434S (SEQ ID NO: 1036)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.241_IgG1_PVA_/S267K/S364K/E357Q/M428L/N434S (SEQ ID NO: 1037)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.92 (SEQ ID NO: 1038)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC > human_IL15Ra(sushi)_(GGGGS)5-human_IL15(D30N/E64Q/N65D;single-chain)-1C11[PD-1]_
H3.328_L3.152_IgG1_Fc(216)_IgG1_pI(-)_Isosteric_A_C220S/PVA_/S267K/L368D/K370S/M428L/N434S-
IgG1_PVA_/S267K/S364K/E357Q/M428L/N434S

**Chain 1 - human_IL15Ra(sushi)_(GGGGS)5-human_IL15(D30N/E64Q/N65D;single-chain)_Fc(216)_IgG1_pI(-
)_Isosteric_A_C220S/PVA_/S267K/L368D/K370S/M428L/N434S (SEQ ID NO: 1039)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVLHEALHSHYTQKSLSLSPGK

Chain 2 - 1C11[PD-1]_ H3.328_IgG1_PVA_/S267K/S364K/E357Q/M428L/N434S (SEQ ID NO: 1040)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVLHEALHSHYTQKSLSLSPGK

Chain 3 - 1C11[PD-1]_ L3.152 (SEQ ID NO: 1041)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 129A

>XENP26007 human_IL15Ra(sushi)_(GGGGS)5-human_IL15(N4D/N65D;single-Chain)-
Numax_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(N4D/N65D;single-Chain)_Fc(216)_IgG1_pI(-
)_Isosteric_A_C220S/PVA_/S267K/L368D/K370S scIL-15/Rα-Fc Chain (SEQ ID NO: 1042)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVDVISDLKKIEDLIQSMHIDATLYTESDVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - Numax_IgG1_PVA_/S267K/S364K/E357Q Heavy Chain (SEQ ID NO: 1043)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax Light Chain (SEQ ID NO: 1044)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC >XENP29481 human_IL15Ra(sushi)_(GGGGS)5-human_IL15(D30N/N65D;single-chain)-
Numax_IgG1_Fc(216)_IgG1_pI(-)_Isosteric_A_C220S/PVA_/S267K/L368D/K370S-
IgG1_PVA_/S267K/S364K/E357Q

**Chain 1 - human_IL15Ra(sushi)_(GGGGS)5-human_IL15(D30N/N65D;single-chain)_Fc(216)_IgG1_pI(-
)_Isosteric_A_C220S/PVA_/S267K/L368D/K370S (SEQ ID NO: 1045)**
ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVEDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - Numax_IgG1_PVA_/S267K/S364K/E357Q (SEQ ID NO: 1046)
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax LC (SEQ ID NO: 1047)
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

Figure 129B

>XENP30432 human_IL15Ra(sushi)_(GGGGS)5-human_IL15(D30N/E64Q/N65D;single-chain)-Numax_IgG1_Fc(216)_IgG1_pI(-)_Isosteric_A_C220S/PVA_/S267K/L368D/K370S-IgG1_PVA_/S267K/S364K/E357Q Chain 1 - human_IL15Ra(sushi)_(GGGGS)5-human_IL15(D30N/E64Q/N65D;single-chain)_Fc(216)_IgG1_pI(-)_Isosteric_A_C220S/PVA_/S267K/L368D/K370S (SEQ ID NO: 1048)

ITCPPPMSVEHADIWVKSYSLYSRERYICNSGFKRKAGTSSLTECVLNKATNVAHWTTPSLKCIR/GGGGSGGGG
SGGGGSGGGGSGGGGS/NWVNVISDLKKIEDLIQSMHIDATLYTESNVHPSCKVTAMKCFLLELQVISLESGDAS
IHDTVQDLIILANNSLSSNGNVTESGCKECEELEEKNIKEFLQSFVHIVQMFINTS/EPKSSDKTHTCPPCPAPP
VAGPSVFLFPPKPKDTLMISRTPEVTCVVVDVKHEDPEVKFNWYVDGVEVHNAKTKPREEEYNSTYRVVSVLTVL
HQDWLNGKEYKCKVSNKALPAPIEKTISKAKGQPREPQVYTLPPSREEMTKNQVSLTCDVSGFYPSDIAVEWESD
GQPENNYKTTPPVLDSDGSFFLYSKLTVDKSRWEQGDVFSCSVMHEALHNHYTQKSLSLSPGK

Chain 2 - Numax_VH_IgG1_IgG1_PVA_/S267K/S364K/E357Q (SEQ ID NO: 1049)

QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK

Chain 3 - Numax LC (SEQ ID NO: 1050)

DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC

PD-1 TARGETED HETERODIMERIC FUSION PROTEINS CONTAINING IL-15/IL-15RA FC-FUSION PROTEINS AND PD-1 ANTIGEN BINDING DOMAINS AND USES THEREOF

CROSS-REFERENCING TO RELATED APPLICATIONS

This application claims priority to U.S. Provisional Application No. 62/659,571, filed Apr. 18, 2018, the disclosure is herein incorporated by reference in its entirety.

SEQUENCE LISTING

The instant application contains a Sequence Listing which has been filed electronically in ASCII format and is hereby incorporated by reference in its entirety. Said ASCII copy, created on May 31, 2019, is named 067461-5204-US_SL.txt and is 3,115,252 bytes in size.

BACKGROUND OF THE INVENTION

Cytokines such as IL-2 and IL-15 function in aiding the proliferation and differentiation of B cells, T cells, and NK cells. Both cytokines exert their cell signaling function through binding to a trimeric complex consisting of two shared receptors, the common gamma chain (γc; CD132) and IL-2 receptor beta-chain (IL-2Rß; CD122), as well as an alpha chain receptor unique to each cytokine: IL-2 receptor alpha (IL-2Rα; CD25) or IL-15 receptor alpha (IL-15Rα; CD215). Both cytokines are considered as potentially valuable therapeutics in oncology, and IL-2 has been approved for use in patients with metastatic renal-cell carcinoma and malignant melanoma. Currently, there are no approved uses of recombinant IL-15, although several clinical trials are ongoing. However, as potential drugs, both cytokines suffer from a very fast clearance, with half-lives measured in minutes. IL-2 immunotherapy has been associated with systemic toxicity when administered in high doses to overcome fast clearance. Such systemic toxicity has also been reported with IL-15 immunotherapy in recent clinical trials (Guo et al., *J Immunol*, 2015, 195(5):2353-64).

Immune checkpoint proteins such as PD-1 are up-regulated following T cell activation to preclude autoimmunity by exhausting activated T cells upon binding to immune checkpoint ligands such as PD-L1. However, immune checkpoint proteins are also up-regulated in tumor-infiltrating lymphocytes (TILs), and immune checkpoint ligands are overexpressed on tumor cells, contributing to immune escape by tumor cells.

There remains an unmet need in oncology treatment for therapeutic strategies with cytokines which do not require high doses and are targeted to tumors to avoid systemic toxicity. The present invention addresses this need by providing PD-1-targeted IL-15 fusion proteins (FIG. 2) with enhanced half-life and more selective targeting of TILs to improve safety profile.

BRIEF SUMMARY OF THE INVENTION

The present invention is directed to novel PD-1 targeted IL-15/Rα heterodimeric Fc fusion proteins, their uses, and methods of making the heterodimeric Fc fusion proteins. comprising:

Accordingly in some aspects, the invention provides PD-1 targeted IL-15/Rα heterodimeric Fc fusion proteins. In this aspect, the PD-1 targeted IL-15/Rα heterodimeric Fc fusion protein comprises:

(a) a first monomer comprising, from N- to C-terminal:
   (i) an IL-15 receptor alpha (IL-15Rα) sushi domain,
   (ii) a first domain linker,
   (iii) a variant IL-15 domain, and
   (iv) a second domain linker, and
   (v) a first variant Fc domain comprising CH2-CH3; and
(b) a second monomer comprising, from N- to C-terminal:
   a heavy chain comprising VH-CH1-hinge-CH2-CH3, wherein said CH2-CH3 is a second variant Fc domain; and
(c) a light chain comprising VL-CL;
wherein said VH and VL form an antigen binding domain that binds human PD-1 and have sequences selected from the pairs consisting of 1C11[PD-1]_H3L3 from XENP22553 (SEQ ID NOS:186 and 187), 1C11[PD-1]_H3.234_L3.144 from XENP25806 (SEQ ID NOS:578-57), 1C11[PD-1]_H3.240_L3.148 from XENP25812 (SEQ ID NO:584), 1C11[PD-1]_H3.241_L3.148 from XENP25813 (SEQ ID NO:585), 1C11[PD-1]_H3.241_L3.92 from XENP25819 (SEQ ID NO:591), 1C11[PD-1]_H3.303_L3.152 from XENP26940 (SEQ ID NOS:642 and 1103), 1C11[PD-1]_H3.329_L3.220 from XENP28026 (SEQ ID NOS:708 and 1169), and 1C11[PD-1]_H3.328_L3.152 from XENP28652 (SEQ ID NOS:719 and 1180); and
wherein said first variant and said second variant Fc domains have a set of amino acid substitutions selected from the group consisting of S267K/L368D/K370S:S267K/LS364K/E357Q; S364K/E357Q:L368D/K370S; L368D/K370S:S364K; L368E/K370S:S364K; T411E/K360E/Q362E:D401K; L368D/K370S:S364K/E357L; L368D/K370S:S364K/E357Q; and K370S:S364K/E357Q, respectively and according to EU numbering.

In some embodiments, the first variant Fc domain and/or the second variant Fc domain of the PD-1 targeted IL-15/Rα heterodimeric Fc fusion protein have amino acid substitutions comprising Q295E/N384D/Q418E/N421D, according to EU numbering.

In some embodiments, the first variant and the variant second Fc domains each have amino acid substitutions selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the first variant and the second variant Fc domains each have amino acid substitution M428L/N434S, according to EU numbering.

In some embodiments, the variant IL-15 domain comprises the amino acid sequence of SEQ ID NO:2. In other embodiments, the variant IL-15 domain comprises the amino acid sequence of SEQ ID NO:2 and amino acid substitutions selected from the group consisting of N4D/N65D, D30N/N65D, and D30N/E64Q/N65D.

In some embodiments, the IL-15Rα sushi domain comprises the amino acid sequence of SEQ ID NO:4.

In some embodiments, the PD-1 targeted IL-15/Rα heterodimeric Fc fusion protein is selected from the group consisting of XENP29482 set forth in SEQ ID NOS:925, 926, and 1216, XENP25937 set forth in SEQ ID NOS:370-372, and any one depicted in FIG. 126A (SEQ ID NOS: 925-929), FIG. 126B (SEQ ID NOS:930-935), FIG. 126C (SEQ ID NOS:936-941), FIG. 126D (SEQ ID NOS:942-947), FIG. 127A (SEQ ID NOS:948-953), FIG. 127B (SEQ ID NOS:954-959), FIG. 127C (SEQ ID NOS:960-965), FIG. 127D (SEQ ID NOS:966-971), FIG. 128A (SEQ ID NOS:972-977), FIG. 128B (SEQ ID NOS:978-983), FIG. 128C (SEQ ID NOS:984-989), FIG. 128D (SEQ ID NOS: 990-995), FIG. 128E (SEQ ID NOS:996-1001), FIG. 128F (SEQ ID NOS:1002-1007), FIG. 128G (SEQ ID NOS:1008-1013), FIG. 128H (SEQ ID NOS:1014-1019), FIG. 128I (SEQ ID NOS:1020-1025), FIG. 128J (SEQ ID NOS:1026-1031), FIG. 128K (SEQ ID NOS:1032-1035), FIG. 128L (SEQ ID NOS:1036-1041).

In further aspects, provided herein is a PD-1 targeted IL-15/Rα heterodimeric Fc fusion protein comprising:
(a) a first monomer comprising, from N- to C-terminal:
  (i) an IL-15 receptor alpha (IL-15Rα) sushi domain,
  (ii) a first domain linker,
  (iii) a variant IL-15 domain,
  (iv) a second domain linker, and
  (v) a first variant Fc domain comprising CH2-CH3; and
(b) a second monomer comprising, from N- to C-terminal: a
  (i) a single chain Fv domain (scFv) that binds human PD-1, wherein said scFv comprises:
    (1) a variable heavy domain (VH),
    (2) a scFv linker, and
    (3) a variable light domain (VL), and
  (ii) a second variant Fc domain;
wherein the VHCDR1, VHCDR2, VHCDR3, VLCDR1, VLCDR2, and VLCDR3 are selected from the group consisting of the CDRs from 1C11[PD-1]_H3L3 from XENP22538 (SEQ ID NO:417), 1C11[PD-1]_H3.234_L3.144 from XENP25806 (SEQ ID NOS:578-579), 1C11[PD-1]_H3.240_L3.148 from XENP25812 (SEQ ID NO:584), 1C11[PD-1]_H3.241_L3.148 from XENP25813 (SEQ ID NO:585), 1C11[PD-1]_H3.241_L3.92 from XENP25819 (SEQ ID NO:591), 1C11[PD-1]_H3.303_L3.152 from XENP26940 (SEQ ID NOS:642 and 1103), 1C11[PD-1]_H3.329_L3.220 from XENP28026 (SEQ ID NOS:708 and 1169), and 1C11[PD-1]_H3.328_L3.152 from XENP28652 (SEQ ID NOS:719 and 1180); and
wherein said first variant and said second variant Fc domains have a set of amino acid substitutions selected from the group consisting of S267K/L368D/K370S: S267K/LS364K/E357Q; S364K/E357Q:L368D/ K370S; L368D/K370S:S364K; L368E/K370S:S364K; T411E/K360E/Q362E:D401K; L368D/K370S:S364K/ E357L; L368D/K370S:S364K/E357Q; and K370S: S364K/E357Q, respectively and according to EU numbering.

In some embodiments, the VH and VL of the second monomer are selected from the pairs consisting of 1C11 [PD-1]_H3L3 from XENP22538 (SEQ ID NO:417), 1C11 [PD-1]_H3.234_L3.144 from XENP25806 (SEQ ID NOS: 578-579), 1C11[PD-1]_H3.240_L3.148 from XENP25812 (SEQ ID NO:584), 1C11[PD-1]_H3.241_L3.148 from XENP25813 (SEQ ID NO:585), 1C11[PD-1]_ H3.241_L3.92 from XENP25819 (SEQ ID NO:591), 1C11 [PD-1]_H3.303_L3.152 from XENP26940 (SEQ ID NOS: 642 and 1103), 1C11[PD-1]_H3.329_L3.220 from XENP28026 (SEQ ID NOS:708 and 1169), and 1C11[PD-1]_H3.328_L3.152 from XENP28652 (SEQ ID NOS:719 and 1180).

In some embodiments, the first variant and the second variant Fc domains have an additional set of amino acid substitutions comprising Q295E/N384D/Q418E/N421D, according to EU numbering.

In some embodiments, the first variant and the variant second Fc domains each have an additional set of amino acid substitutions consisting of G236R/L328R, E233P/L234V/ L235A/G236del/S239K, E233P/L234V/L235A/G236del/ S267K, E233P/L234V/L235A/G236del/S239K/A327G, E233P/L234V/L235A/G236del/S267K/A327G and E233P/ L234V/L235A/G236del, according to EU numbering.

In some embodiments, the first variant and the second variant Fc domains each have an additional amino acid substitution M428L/N434S, according to EU numbering.

In some embodiments, the variant IL-15 domain comprises the amino acid sequence of SEQ ID NO:2. In certain embodiments, the variant IL-15 domain comprises the amino acid sequence of SEQ ID NO:2 and amino acid substitutions selected from the group consisting of N4D/ N65D, D30N/N65D, and D30N/E64Q/N65D.

In some embodiments, the IL-15Rα sushi domain has the amino acid sequence of SEQ ID NO:4.

In some embodiments, the first monomer comprises: the IL-15Rα sushi domain of SEQ ID NO:4 and the variant IL-15 domain of SEQ ID NO:2 having amino acid substitutions selected from the group consisting of N4D/N65D, D30N/N65D, and D30N/E64Q/N65D; and the scFv comprises: the VH and VL are selected from the pairs consisting of 1C11[PD-1]_H3.234_L3.144 from XENP25806 (SEQ ID NOS:578-579), 1C11[PD-1]_H3.240_L3.148 from XENP25812 (SEQ ID NO:584), 1C11[PD-1]_ H3.241_L3.148 from XENP25813 (SEQ ID NO:585), 1C11 [PD-1]_H3.241_L3.92 from XENP25819 (SEQ ID NO:591), 1C11[PD-1]_H3.303_L3.152 from XENP26940 (SEQ ID NOS:642 and 1103), 1C11[PD-1]_H3.329_L3.220 from XENP28026 (SEQ ID NOS:708 and 1169), and 1C11 [PD-1]_H3.328_L3.152 from XENP28652 (SEQ ID NOS: 719 and 1180).

In other aspects, provided herein is a nucleic acid composition encoding the first monomer of any heterodimeric Fc fusion protein outlined herein. Also, provided herein is a nucleic acid composition encoding the second monomer of any heterodimeric Fc fusion protein outlined herein. Also, provided is a nucleic acid composition encoding the light chain of any heterodimeric Fc fusion protein outlined herein.

In some aspects, provided herein is an expression vector comprising any of the nucleic acid composition encoding any one of the first monomers described herein. Also, provided herein is an expression vector comprising any of the nucleic acid composition encoding any one of the second monomers described herein. Also, provided herein is an expression vector comprising any of the nucleic acid composition encoding any one of the light chains described herein such that the VL and VH of the heterodimeric Fc fusion protein binds human PD-1.

Provided herein is an expression vector comprising one or more of the nucleic acid compositions described herein. Provided herein is a host cell comprising one or more expression vectors.

In some aspects, provided herein is a method of producing a PD-1 targeted IL-15/Rα heterodimeric Fc fusion protein comprising: culturing the host cell described herein under suitable conditions, wherein the heterodimeric Fc fusion protein is expressed; and recovering the protein.

In some aspects, the invention provides a PD-1 targeted IL-15/Rα heterodimeric Fc fusion protein selected from the group consisting of XENP29482 set forth in SEQ ID NOS: 925, 926, and 1216, XENP25937 set forth in SEQ ID NOS: 370-372, and any one depicted in FIG. 126A (SEQ ID NOS:925-929), FIG. 126B (SEQ ID NOS: 930-935), FIG. 126C (SEQ ID NOS:936-941), FIG. 126D (SEQ ID NOS: 942-947), FIG. 127A (SEQ ID NOS:948-953), FIG. 127B (SEQ ID NOS:954-959), FIG. 127C (SEQ ID NOS:960-965), FIG. 127D (SEQ ID NOS:966-971), FIG. 128A (SEQ ID NOS:972-977), FIG. 128B (SEQ ID NOS:978-983), FIG. 128C (SEQ ID NOS:984-989), FIG. 128D (SEQ ID NOS:990-995), FIG. 128E (SEQ ID NOS:996-1001), FIG. 128F (SEQ ID NOS:1002-1007), FIG. 128G (SEQ ID NOS:1008-1013), FIG. 128H (SEQ ID NOS:1014-1019), FIG. 128I (SEQ ID NOS:1020-1025), FIG. 128J (SEQ ID NOS:1026-1031), FIG. 128K (SEQ ID NOS:1032-1035), FIG. 128L (SEQ ID NOS:1036-1041).

In other aspects, the invention provides a pharmaceutical composition comprising a PD-1 targeted IL-15/Rα heterodimeric Fc fusion protein selected from the group consisting of XENP29482 set forth in SEQ ID NOS:925, 926, and 1216, XENP25937 set forth in SEQ ID NOS: 370-372, and any one depicted in FIG. 126A (SEQ ID NOS:925-929), FIG. 126B (SEQ ID NOS: 930-935), FIG. 126C (SEQ ID NOS:936-941), FIG. 126D (SEQ ID NOS:942-947), FIG. 127A (SEQ ID NOS:948-953), FIG. 127B (SEQ ID NOS: 954-959), FIG. 127C (SEQ ID NOS:960-965), FIG. 127D (SEQ ID NOS:966-971), FIG. 128A (SEQ ID NOS:972-977), FIG. 128B (SEQ ID NOS:978-983), FIG. 128C (SEQ ID NOS:984-989), FIG. 128D (SEQ ID NOS:990-995), FIG. 128E (SEQ ID NOS:996-1001), FIG. 128F (SEQ ID NOS:1002-1007), FIG. 128G (SEQ ID NOS:1008-1013), FIG. 128H (SEQ ID NOS:1014-1019), FIG. 128I (SEQ ID NOS:1020-1025), FIG. 128J (SEQ ID NOS:1026-1031), FIG. 128K (SEQ ID NOS:1032-1035), FIG. 128L (SEQ ID NOS:1036-1041), and a pharmaceutically acceptable carrier.

In certain aspects, the invention provides method of treating cancer in a patient in need thereof comprising administering a therapeutically effective amount of any one of the PD-1 targeted IL-15/Rα heterodimeric Fc fusion proteins described herein, or a pharmaceutical composition thereof.

In some embodiments, the method also comprises administering a therapeutically effective amount of a checkpoint blockade antibody.

In some embodiments, the checkpoint blockade antibody is selected from the group consisting of an anti-PD-1 antibody, an anti-PD-L1 antibody, an anti-TIM3 antibody, an anti-TIGIT antibody, an anti-LAG3 antibody, and an anti-CTLA-4 antibody.

In some embodiments, the said anti-PD-1 antibody is nivolumab, pembrolizumab, or pidilizumab. In some embodiments, the anti-PD-L1 antibody is atezolizumab, avelumab, or durbalumab.

BRIEF DESCRIPTION OF THE DRAWINGS

FIGS. 3A-3B depict the sequences for IL-15 and its receptors.

FIGS. 4A-4E depict useful pairs of Fc heterodimerization variant sets (including skew and pI variants). There are variants for which there are no corresponding "monomer 2" variants; these are pI variants which can be used alone on either monomer.

FIG. 5 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein).

FIG. 6 depicts useful ablation variants that ablate FcγR binding (sometimes referred to as "knock outs" or "KO" variants). Generally, ablation variants are found on both monomers, although in some cases they may be on only one monomer.

FIGS. 7A-7E show a particularly useful embodiments of "non-cytokine" components of the IL-15/Rα-Fc fusion proteins of the invention.

FIG. 8A-FIG. 8F show particularly useful embodiments of "non-cytokine"/"non-Fv" components of the PD-1-targeted IL-15/Rα-Fc fusion proteins of the invention.

FIG. 9 depicts a number of exemplary variable length linkers for use in IL-15/Rα-Fc fusion proteins. In some embodiments, these linkers find use linking the C-terminus of IL-15 and/or IL-15Rα(sushi) to the N-terminus of the Fc region. In some embodiments, these linkers find use fusing IL-15 to the IL-15Rα(sushi).

FIG. 10 depicts a number of charged scFv linkers that find use in increasing or decreasing the pI of heterodimeric antibodies that utilize one or more scFv as a component. The (+H) positive linker finds particular use herein. A single prior art scFv linker with single charge is referenced as "Whitlow", from Whitlow et al., Protein Engineering 6(8): 989-995 (1993). It should be noted that this linker was used for reducing aggregation and enhancing proteolytic stability in scFvs.

FIGS. 11A-11D show the sequences of several useful IL-15/Rα-Fc format backbones based on human IgG1, without the cytokine sequences (e.g., the IL-15 and/or IL-15Rα (sushi)). It is important to note that these backbones can also find use in certain embodiments of PD-1 targeted IL-15/Rα-Fc proteins. Backbone 1 is based on human IgG1 (356E/358M allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chain, the S364K:L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chain, the S364K:L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chain, the D401K:K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chain, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chain, the S364K/E357Q:L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/N384D/Q418E/N421D pI variants on the chain with L368D/K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/P229R/N276K pI variants on the chain with S364K/E357Q skew variants and the E233P/L234V/L235A/G236del/S267K ablation variants on both chains.

Figure 1:
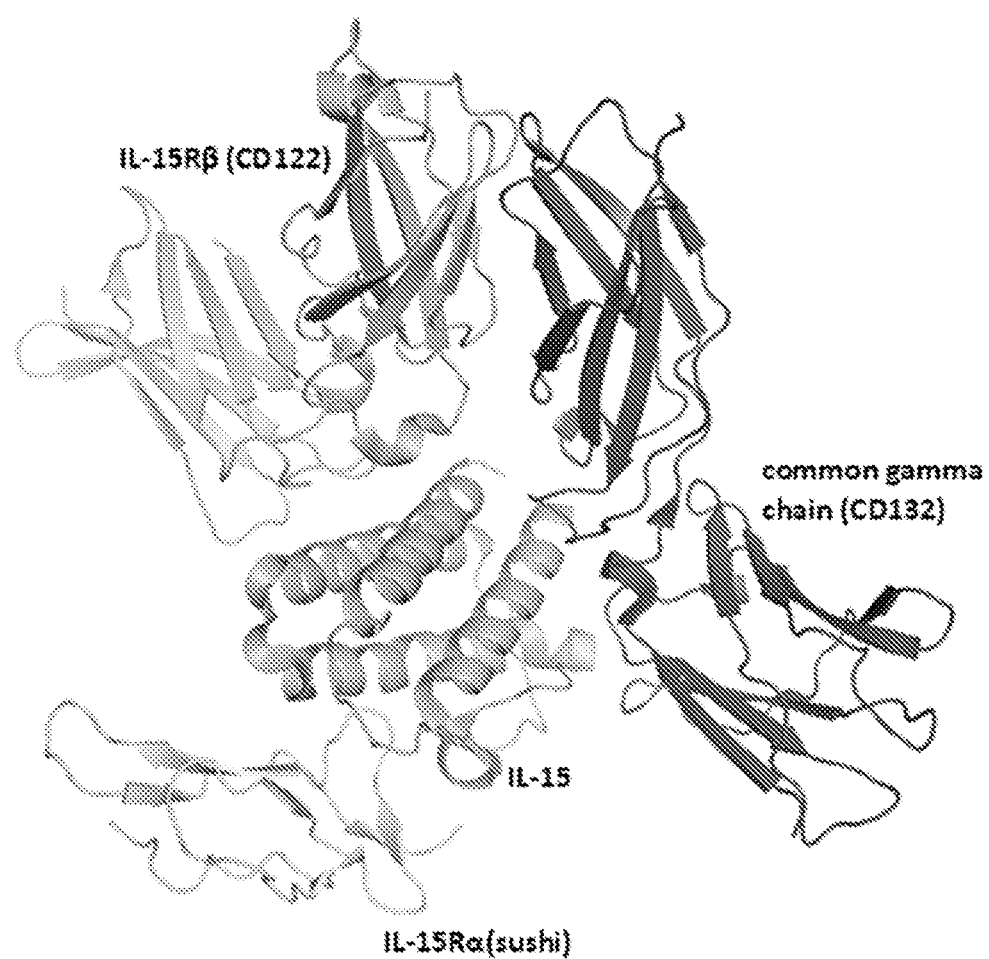
FIG. 1 depicts the structure of IL-15 in complex with its receptors IL-15Rα (CD215), IL-15Rβ (CD122), and the common gamma chain (CD132).
Figure 2:
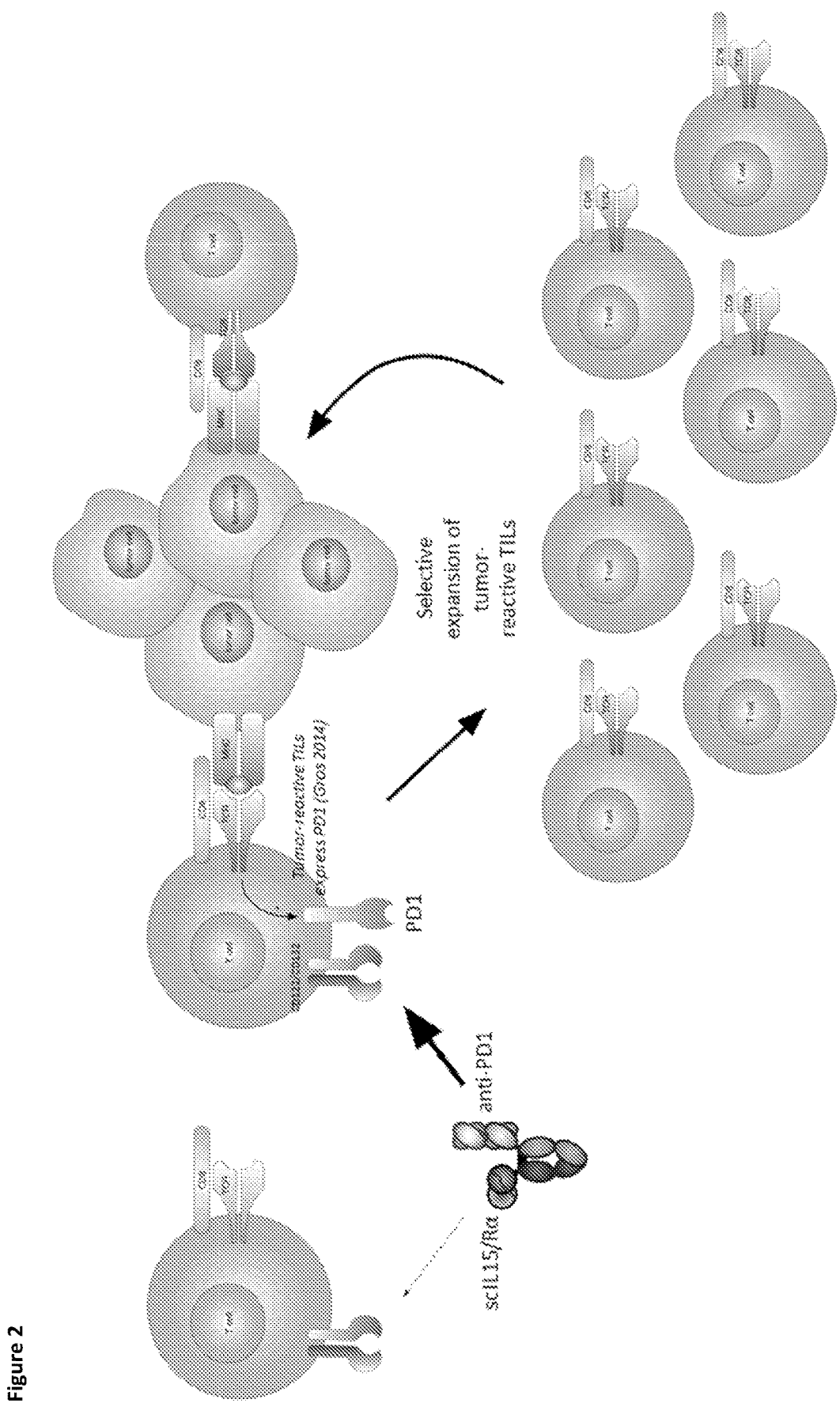
FIG. 2 depicts selectivity of PD-1-targeted IL-15/Rα-Fc fusion proteins for tumor-reactive tumor-infiltrating lymphocytes expressing PD-1.

As will be appreciated by those in the art and outlined below, these sequences can be used with any IL-15 and IL-15Rα(sushi) pairs outlined herein, including but not limited to IL-15/Rα-heteroFc, ncIL-15/Rα, and scIL-15/Rα, as schematically depicted in FIGS. 22 and 36. Additionally, any IL-15 and/or IL-15Rα(sushi) variants can be incorporated into these FIGS. 11A-11D backbones in any combination.

Included within each of these backbones are sequences that are 90%, 95%, 98%, and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of FIGS. 11A-11D.

FIG. 12 shows the sequences of several useful PD-1-targeted IL-15/Rα-Fc fusion format backbones based on human IgG1, without the cytokine sequences (e.g., the 11-15 and/or IL-15Rα(sushi)) or VH, and further excluding light chain backbones which are depicted in FIG. 13. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes the S364K/E357Q:L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/358M allotype), and includes the S364K/E357Q:L368D/K370S skew variants, the N208D/Q295E/N384D/Q418E/N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIGS. 4A-4E, 5 and 6.

As will be appreciated by those in the art and outlined below, these sequences can be used with any IL-15 and IL-15Rα(sushi) pairs outlined herein, including but not limited to scIL-15/Rα, ncIL-15/Rα, and dsIL-15Rα, as schematically depicted in FIGS. 65A-65K. Further as will be appreciated by those in the art and outlined below, any IL-15 and/or IL-15Rα(sushi) variants can be incorporated in these backbones. Furthermore as will be appreciated by those in the art and outlined below, these sequences can be used with any VH and VL pairs outlined herein, including either a scFv or a Fab.

Included within each of these backbones are sequences that are 90%, 95%, 98% and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 13 depicts the "non-Fv" backbone of light chains (i.e., constant light chain) which find use in PD-1-targeted IL-15/Rα-Fc fusion proteins of the invention.

FIG. 14 depicts the variable region sequences for an illustrative anti-PD-1 binding domain. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and VL domains using other numbering systems. Furthermore, as for all the sequences in the figures, these $V_H$ and VL sequences can be used either in a scFv format or in a Fab format.

FIGS. 15A-15F depict the variable regions of additional PD-1-3 ABDs which may find use in the PD-1-targeted IL-15/Rα-Fc fusion proteins of the invention. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and VL domains using other numbering systems. Furthermore, as for all the sequences in the Figures, these $V_H$ and VL sequences can be used either in a scFv format or in a Fab format.

FIG. 16 depicts the sequences for XENP21575, a chimeric anti-PD-1 antibody based on the variable regions of hybridoma clone 1C11 and human IgG1 with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems.

Figure 17:
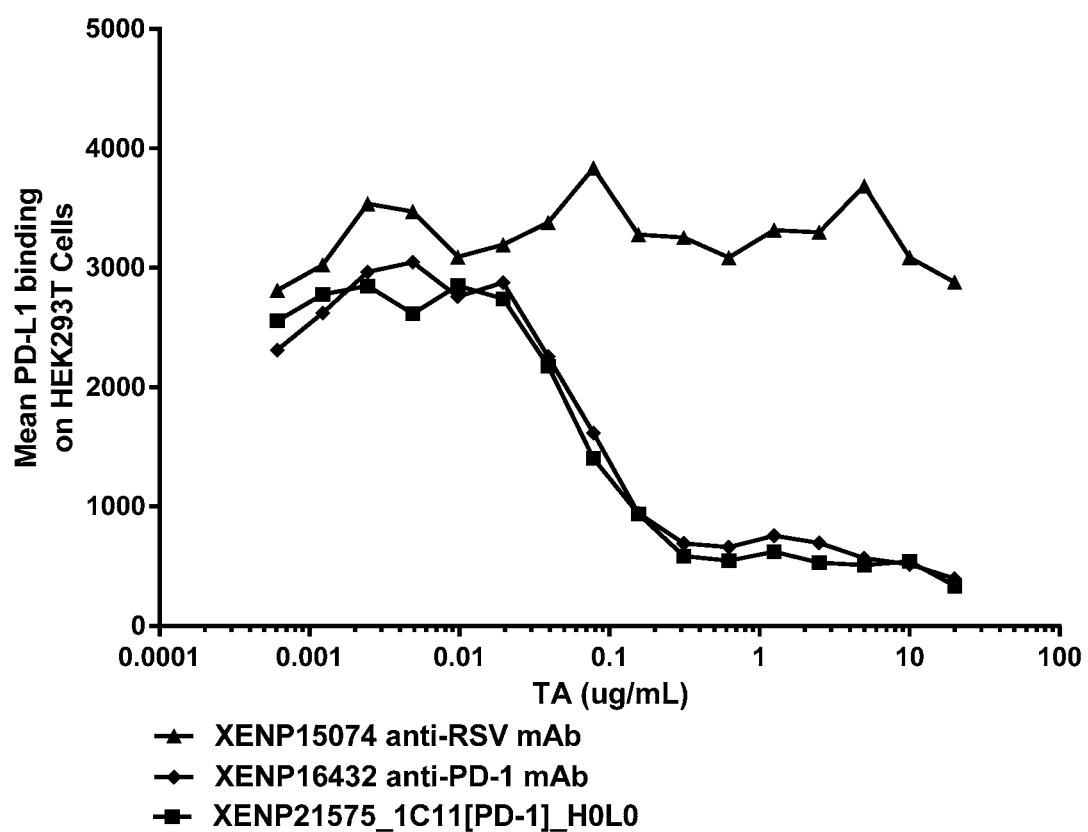

FIG. 17 depicts blocking of PD-1/PD-L1 interaction on PD-1 transfected HEK293T cells by anti-PD-1 clone 1C11.

Figure 18:
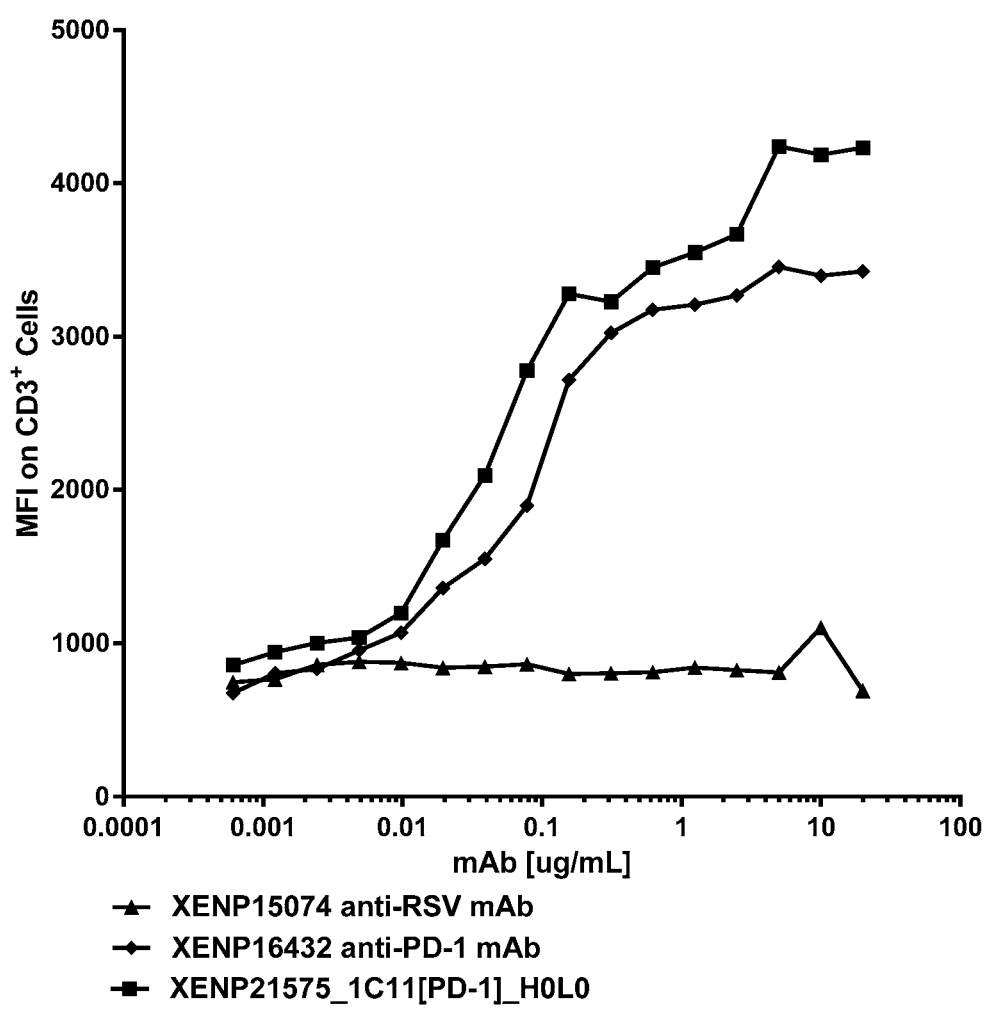

FIG. 18 depicts the binding of anti-PD-1 clone 1C11 to SEB-stimulated T cells.

Figure 19A:
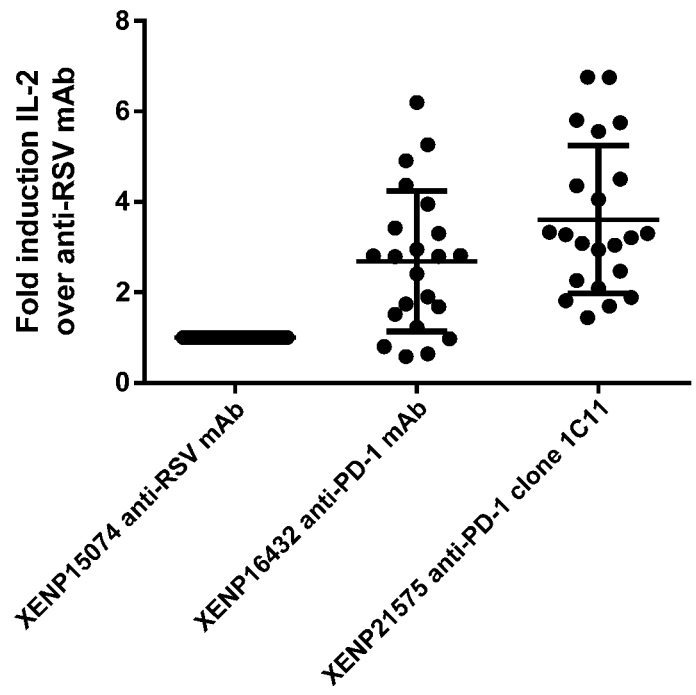
Figure 19B:
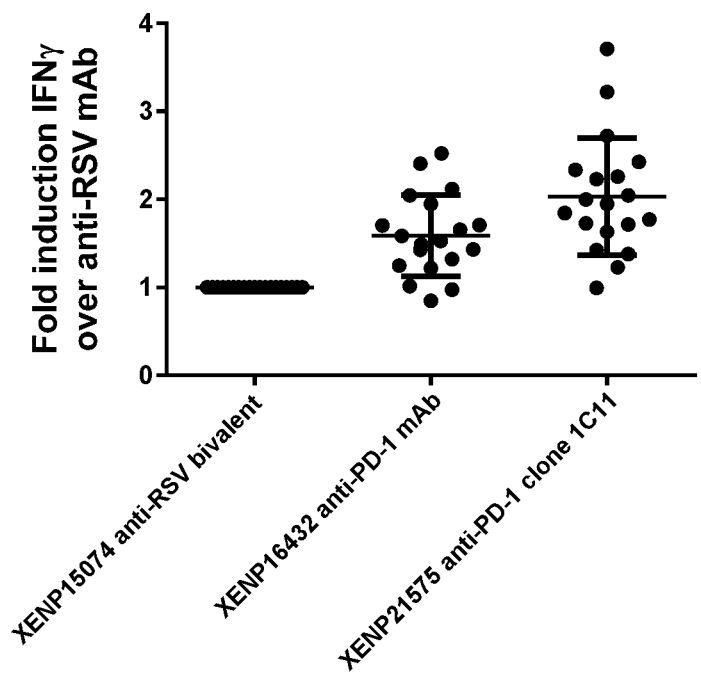

FIGS. 19A-19B depict cytokine release assays (FIG. 19A: IL-2; FIG. 19B: IFNγ) after SEB stimulation of human PBMCs and treatment with anti-PD-1 clone 1C11.

FIGS. 20A-20C depict the sequences for illustrative humanized variants of anti-PD-1 clone 1C11 as a bivalent antibodies in the human IgG1 format with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are bolded but also CDRs included within the $V_H$ and $V_L$ domains using other numbering systems. As will be appreciated by those in the art, the $V_H$ and $V_L$ domains can be formatted as Fab or scFvs for use in the PD-1 targeted IL-15/Rα-Fc fusion proteins of the invention.

Figure 21:
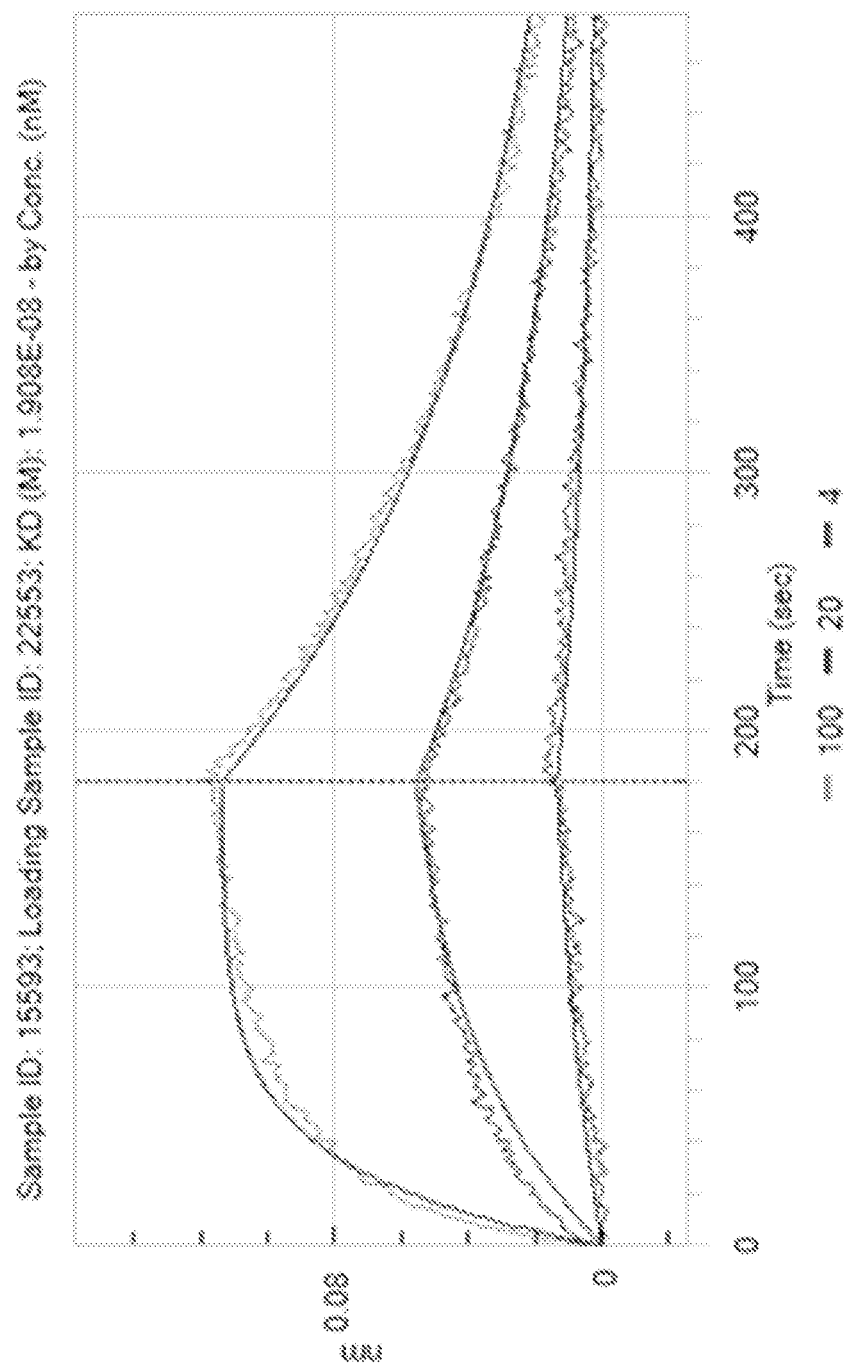

FIG. 21 depicts the affinity of XENP22553 for PD-1 as determined by Octet (as well as the associated sensorgram).

FIGS. 22A-22G depict several formats for the IL-15/Rα-Fc fusion proteins of the present invention. IL-15Rα Heterodimeric Fc fusion or "IL-15/Rα-heteroFc" (FIG. 22A) comprises IL-15 recombinantly fused to one side of a heterodimeric Fc and IL-15Rα(sushi) recombinantly fused to the other side of a heterodimeric Fc. The IL-15 and IL-15Rα(sushi) may have a variable length Gly-Ser linker between the C-terminus and the N-terminus of the Fc region. Single-chain IL-15/Rα-Fc fusion or "scIL-15/Rα-Fc" (FIG. 22B) comprises IL-15Rα(sushi) fused to IL-15 by a variable length linker (termed a "single-chain" IL-15/IL-15Rα(sushi) complex or "scIL-15/Rα") which is then fused to the N-terminus of a heterodimeric Fc-region, with the other side of the molecule being "Fc-only" or "empty Fc". Non-covalent IL-15/Rα-Fc or "ncIL-15/Rα-Fc" (FIG. 22C) comprises IL-15Rα(sushi) fused to a heterodimeric Fc region, while IL-15 is transfected separately so that a non-covalent IL-15/Rα complex is formed, with the other side of the molecule being "Fc-only" or "empty Fc". Bivalent non-covalent IL-15/Rα-Fc fusion or "bivalent ncIL-15/Rα-Fc" (FIG. 22D) comprises IL-15Rα(sushi) fused to the N-terminus of a homodimeric Fc region, while IL-15 is transfected separately so that a non-covalent IL-15/Rα complex is formed. Bivalent single-chain IL-15/Rα-Fc fusion or "bivalent scIL-15/Rα-Fc" (FIG. 22E) comprises IL-15 fused to IL-15Rα(sushi) by a variable length linker (termed a "single-chain" IL-15/IL-15Rα(sushi) complex or "scIL-15/Rα") which is then fused to the N-terminus of a homodimeric Fc-region. Fc-non-covalent IL-15/Rα fusion or "Fc-ncIL-15/Rα" (FIG. 22F) comprises IL-15Rα(sushi) fused to the C-terminus of a heterodimeric Fc region, while IL-15 is transfected separately so that a non-covalent IL-15/Rα complex is formed, with the other side of the molecule being "Fc-only" or "empty Fc". Fc-single-chain IL-15/Rα fusion or "Fc-scIL-15/Rα" (FIG. 22G) comprises IL-15 fused to IL-15Rα(sushi) by a variable length linker (termed a "single-chain" IL-15/IL-15Rα(sushi) complex or "scIL-15/Rα") which is then fused to the C-terminus of a heterodimeric Fc region, with the other side of the molecule being "Fc-only" or "empty Fc".

FIG. 23 depicts sequences of XENP20818 and XENP21475, illustrative IL-15/Rα-Fc fusion proteins of the "IL-15/Rα-heteroFc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 24 depicts sequences of XENP21478, an illustrative IL-15/Rα-Fc fusion protein of the "scIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIGS. 25A-25B depict sequences of XENP21479, XENP22366 and XENP24348, illustrative IL-15/Rα-Fc fusion proteins of the "ncIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 26 depicts sequences of XENP21978, an illustrative IL-15/Rα-Fc fusion protein of the "bivalent ncIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 27 depicts sequences of an illustrative IL-15/Rα-Fc fusion protein of the "bivalent scIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 28 depicts sequences of XENP22637, an illustrative IL-15/Rα-Fc fusion protein of the "Fc-ncIL-15/Rα" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 29 depicts sequences of an illustrative IL-15/Rα-Fc fusion protein of the "Fc-scIL-15/Rα" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

Figure 30A:
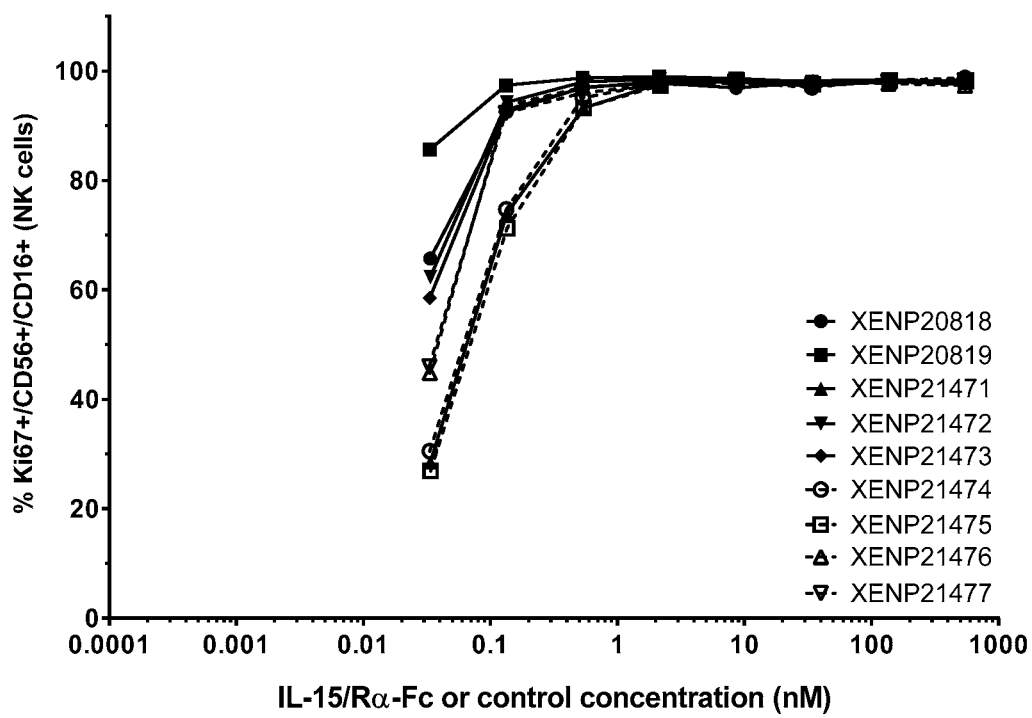
Figure 30B:
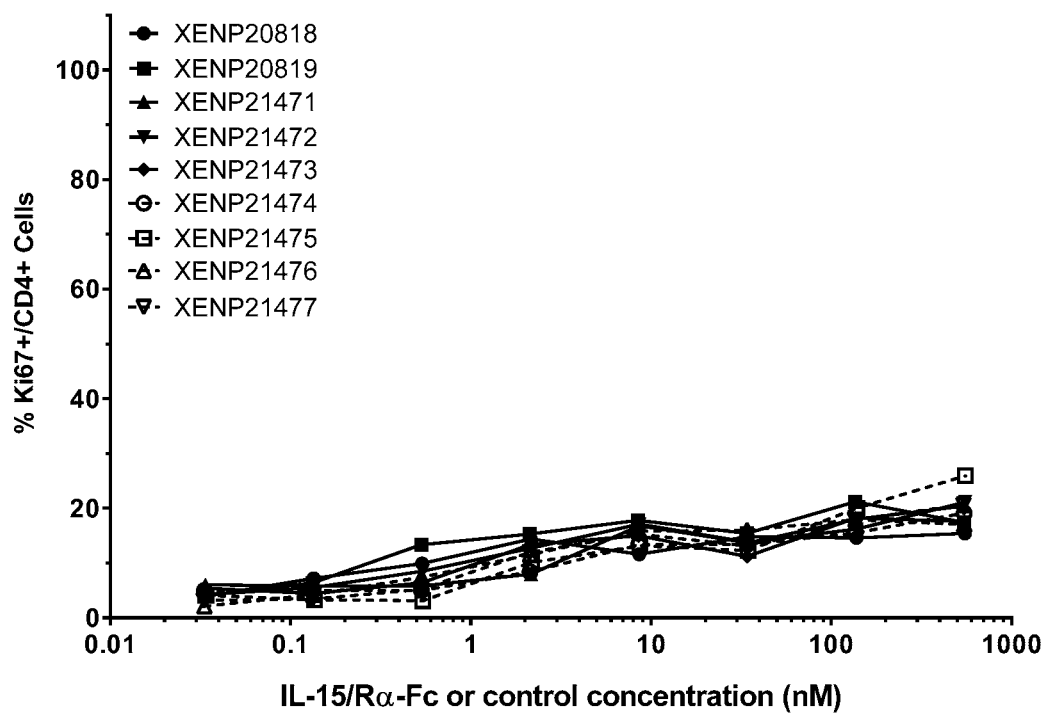
Figure 30C:
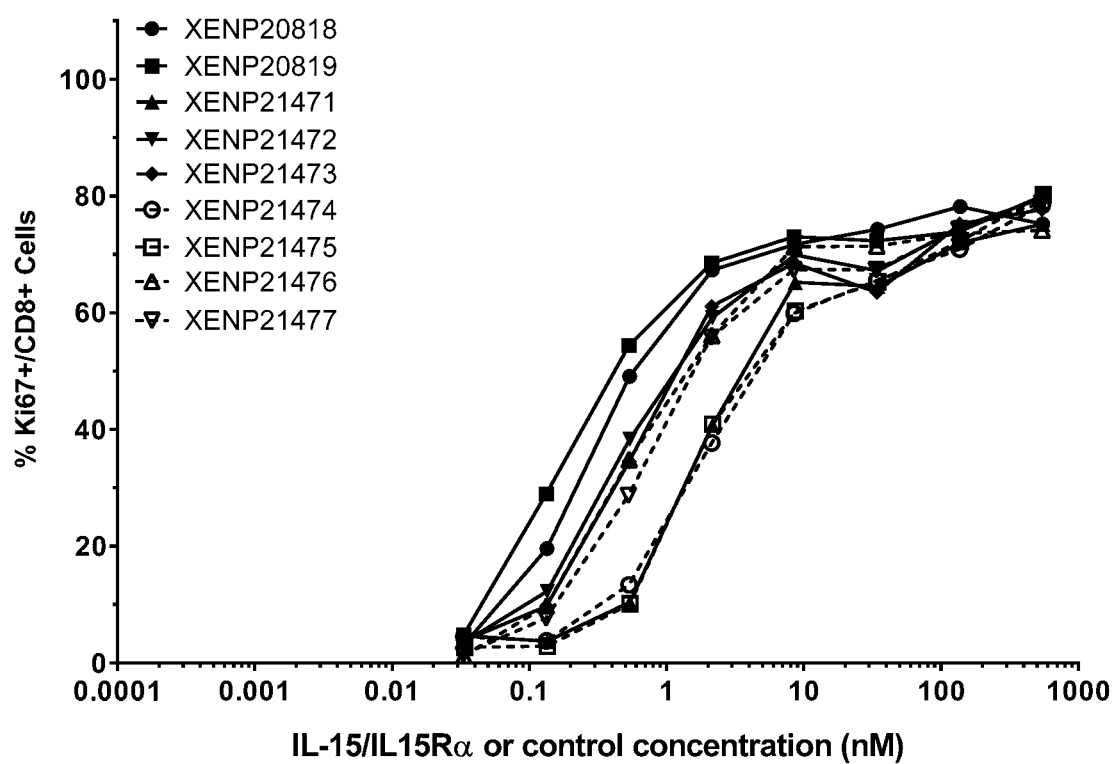

FIG. 30A-FIG. 30C depict the induction of (FIG. 30A) NK (CD56+/CD16+) cells, (FIG. 30B) CD4+ T cells, and (FIG. 30C) CD8+ T cells proliferation by illustrative IL-15/Rα-Fc fusion proteins of Format A with different linker lengths based on Ki67 expression as measured by FACS.

Figure 31A:
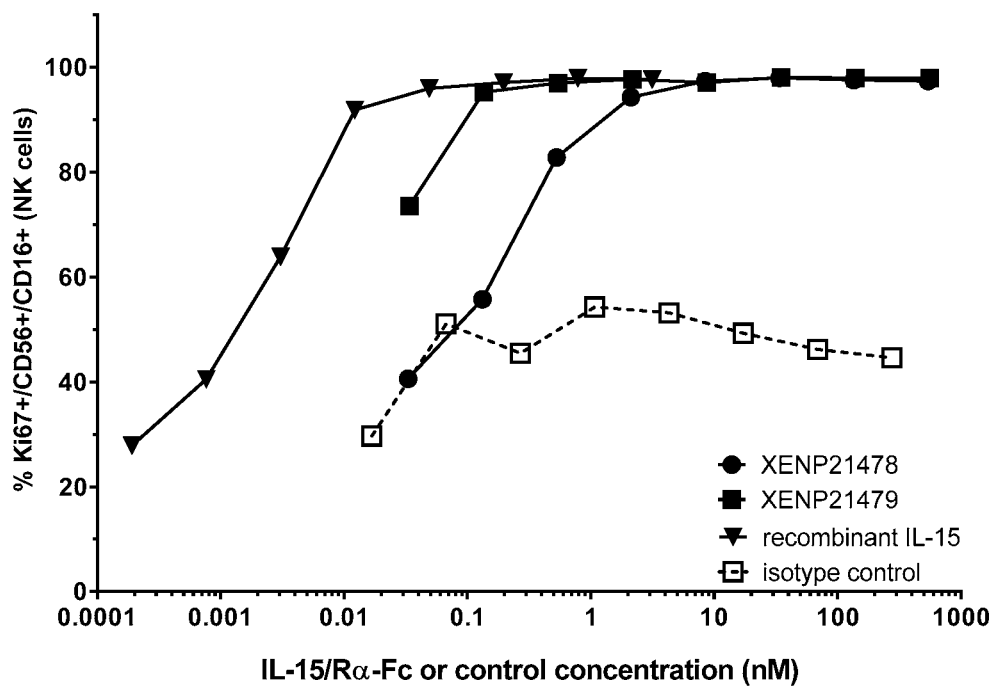
Figure 31B:
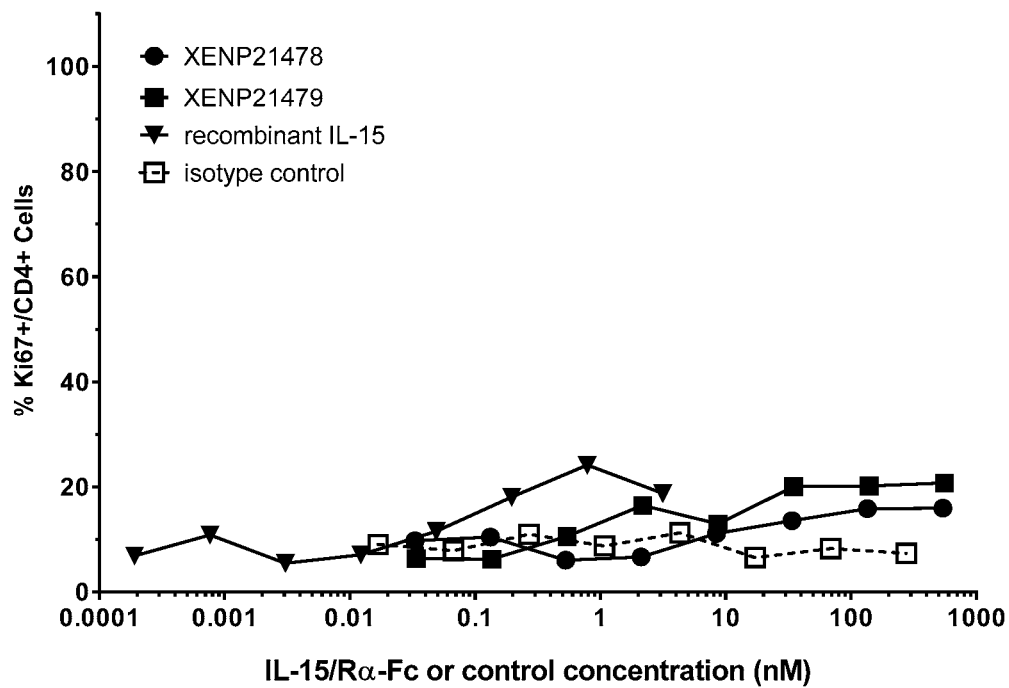
Figure 31C:
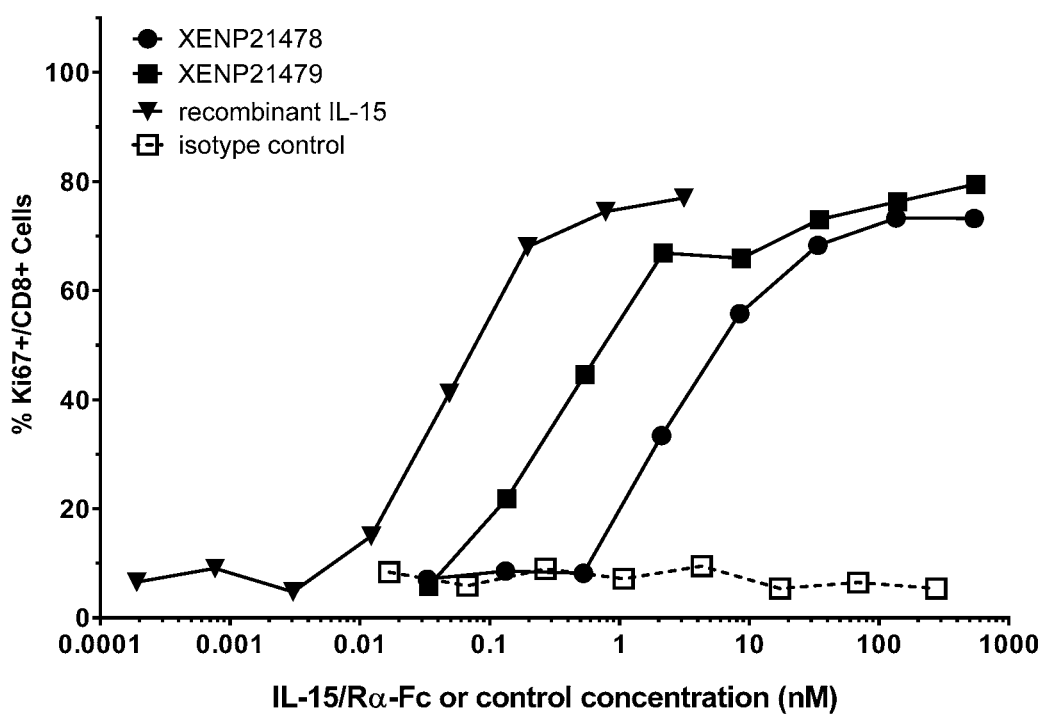

FIGS. 31A-31C depict the induction of (FIG. 31A) NK (CD56+/CD16+) cells, (FIG. 31B) CD4+ T cells, and (FIG. 31C) CD8+ T cells proliferation by illustrative IL-15/Rα-Fc fusion proteins of scIL-15/Rα-Fc format (XENP21478) and ncIL-15/Rα-Fc format (XENP21479) based on Ki67 expression as measured by FACS.

Figure 32:
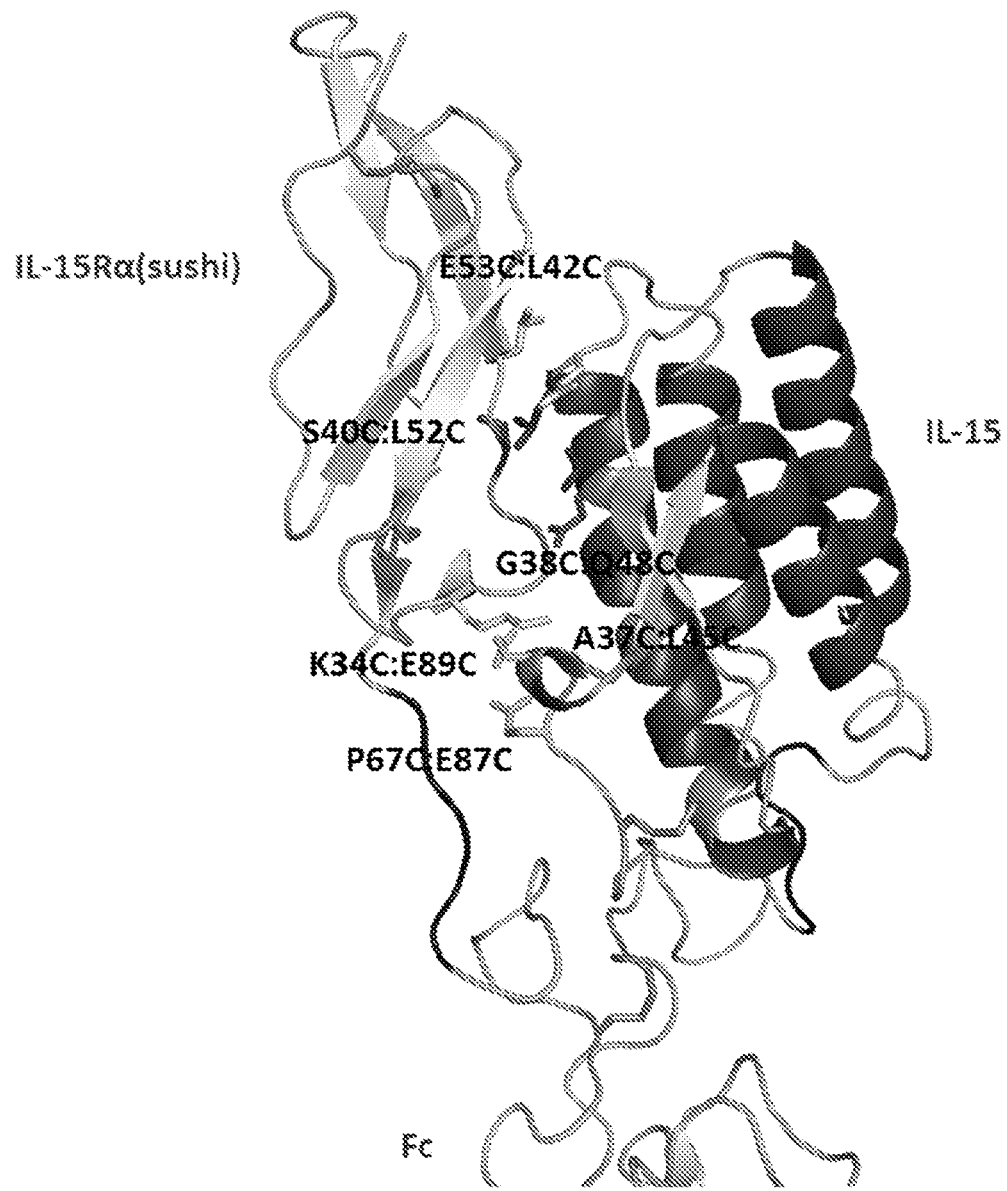
Figure 36A:
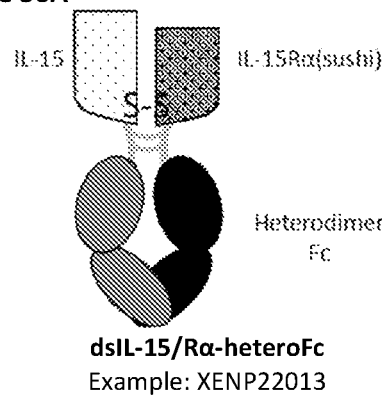
Figure 36B:
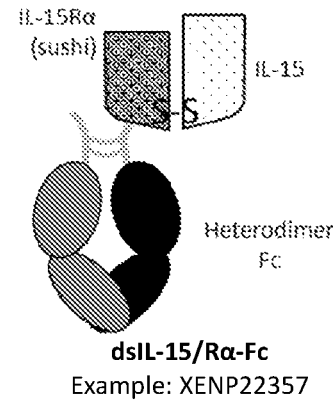
Figure 36C:
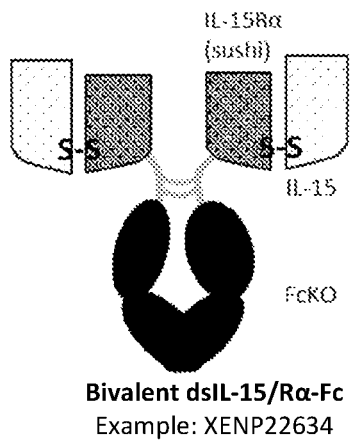
Figure 36D:
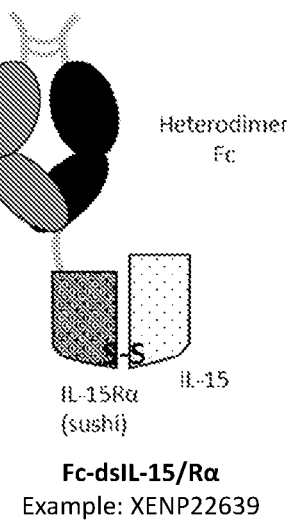

FIG. 32 depicts a structural model of the IL-15/Rα heterodimer showing locations of engineered disulfide bond pairs.

FIG. 33 depicts sequences for illustrative IL-15Rα(sushi) variants engineered with additional residues at the C-terminus to serve as a scaffold for engineering cysteine residues.

FIG. 34 depicts sequences for illustrative IL-15 variants engineered with cysteines in order to form covalent disulfide bonds with IL-15Rα(sushi) variants engineered with cysteines.

FIG. 35 depicts sequences for illustrative IL-15Rα(sushi) variants engineered with cysteines in order to form covalent disulfide bonds with IL-15 variants engineered with cysteines.

FIGS. 36A-36D depict additional formats for the IL-15/Rα-Fc fusion proteins of the present invention with engineered disulfide bonds. Disulfide-bonded IL-15/Rα heterodimeric Fc fusion or "dsIL-15/Rα-heteroFc" (FIG. 36A) is the same as "IL-15/Rα-heteroFc", but wherein IL-15Rα (sushi) and IL-15 are further covalently linked as a result of engineered cysteines. Disulfide-bonded IL-15/Rα Fc fusion or "dsIL-15/Rα-Fc" (FIG. 36B) is the same as "ncIL-15/Rα-Fc", but wherein IL-15Rα(sushi) and IL-15 are further covalently linked as a result of engineered cysteines. Bivalent disulfide-bonded IL-15/Rα-Fc or "bivalent dsIL-15/Rα-Fc" (FIG. 36C) is the same as "bivalent ncIL-15/Rα-Fc", but wherein IL-15Rα(sushi) and IL-15 are further covalently linked as a result of engineered cysteines. Fc-disulfide-bonded IL-15/Rα fusion or "Fc-dsIL-15/Rα" (FIG. 36D) is the same as "Fc-ncIL-15/Rα", but wherein IL-15Rα(sushi) and IL-15 are further covalently linked as a result of engineered cysteines.

FIGS. 37A-37B depict sequences of XENP22013, XENP22014, XENP22015, and XENP22017, illustrative IL-15/Rα-Fc fusion protein of the "dsIL-15/Rα-heteroFc" format. IL-15 and IL-15Rα(sushi) are underlined, linkers are double underlined (although as will be appreciated by those in the art, the linkers can be replaced by other linkers, some of which are depicted in FIG. 9), and slashes (/) indicate the border(s) between IL-15, IL-15Rα, linkers, and Fc regions.

FIGS. 38A-38B depict sequences of XENP22357, XENP22358, XENP22359, XENP22684, and XENP22361, illustrative IL-15/Rα-Fc fusion proteins of the "dsIL-15/Rα-Fc" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIG. 39 depicts sequences of XENP22634, XENP22635, and XENP22636, illustrative IL-15/Rα-Fc fusion proteins of the "bivalent dsIL-15/Rα-Fc" format. IL-15 and IL-15Rα (sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, and Fc regions.

FIG. 40 depicts sequences of XENP22639 and XENP22640, illustrative IL-15/Rα-Fc fusion proteins of the "Fc-dsIL-15/Rα" format. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

Figure 41:
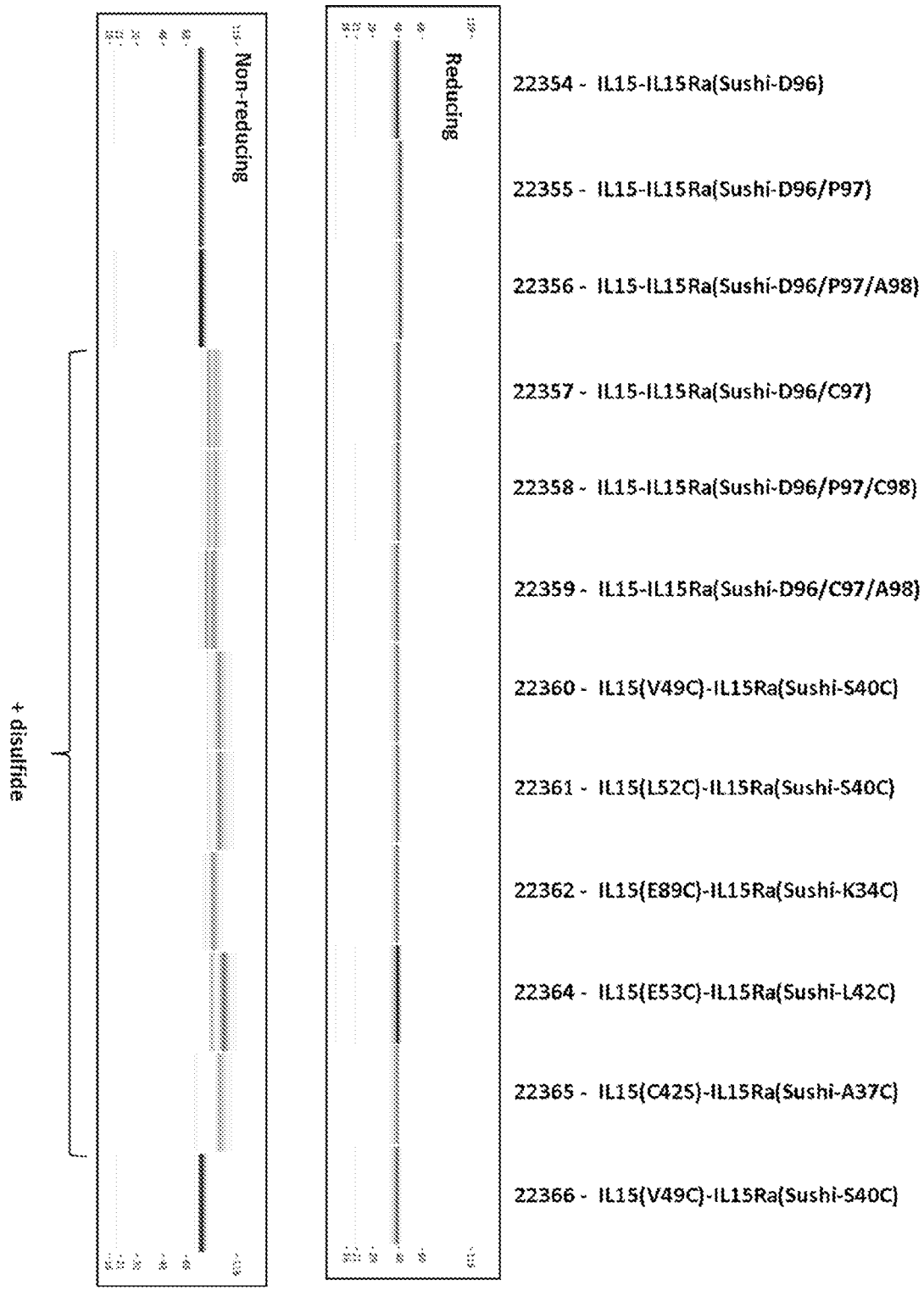

FIG. 41 depicts the purity and homogeneity of illustrative IL-15/Rα-Fc fusion proteins with and without engineered disulfide bonds as determined by CEF.

Figure 42A:
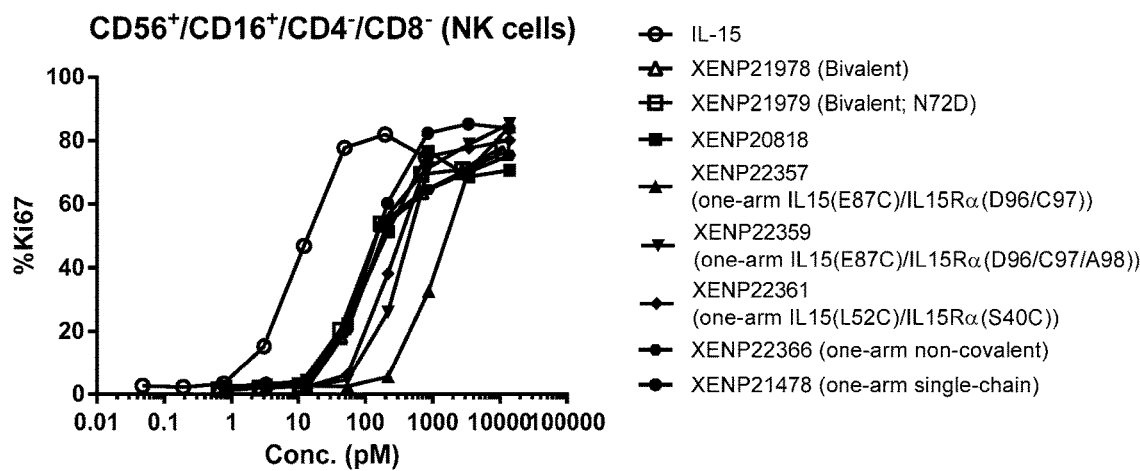
Figure 42B:
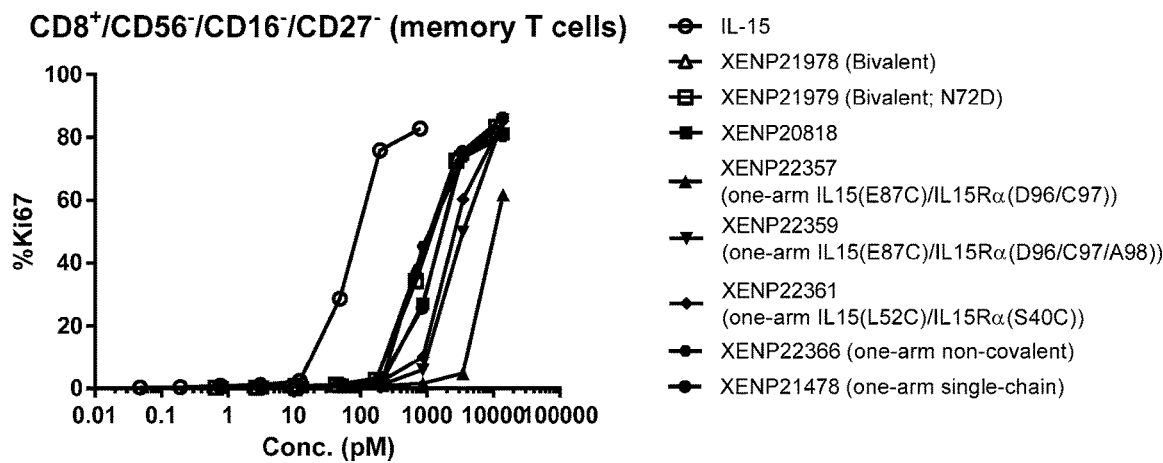
Figure 42C:
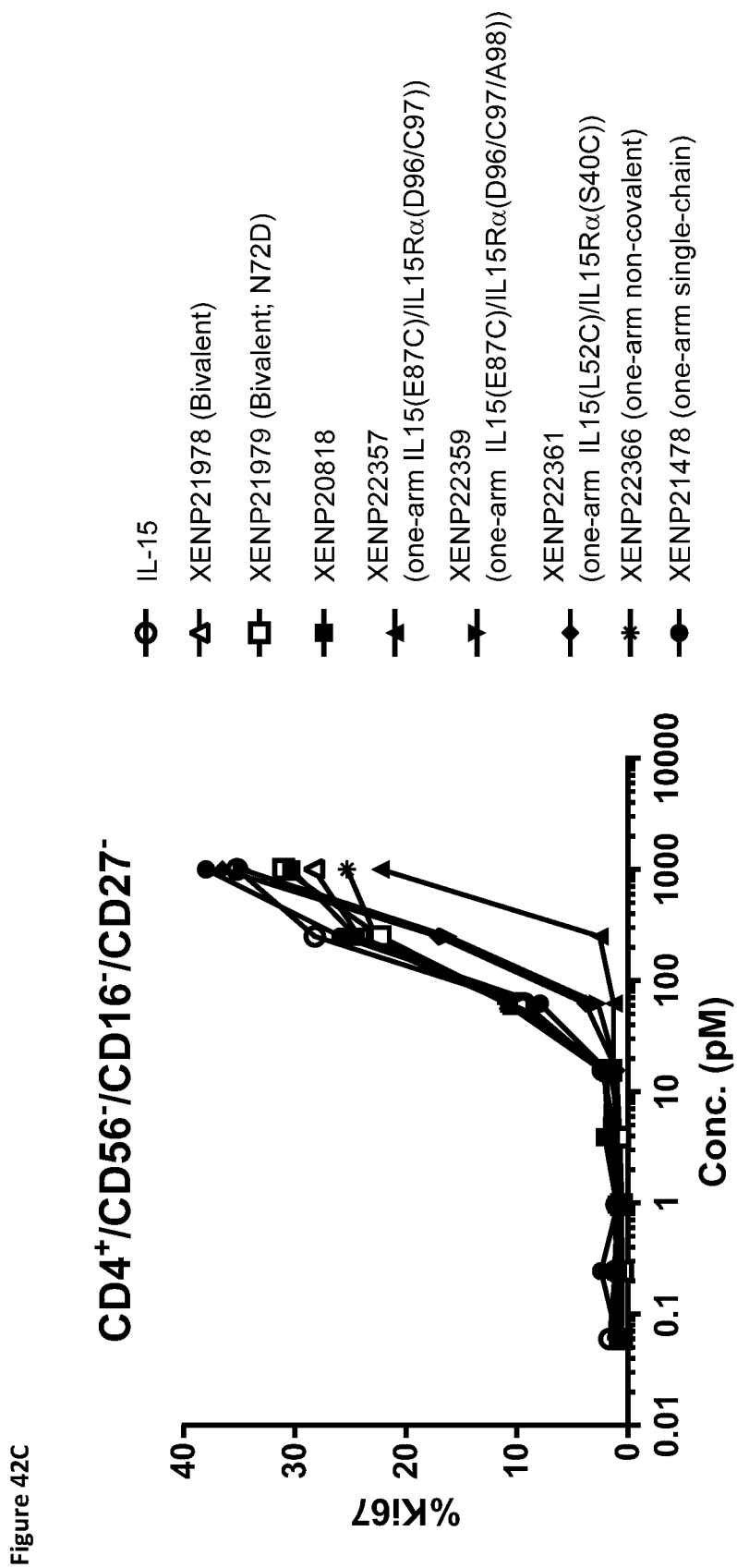

FIGS. 42A-42C depicts the induction of A) NK (CD56+/CD16+) cell, B) CD8+ T cell, and C) CD4+ T cell proliferation by illustrative IL-15/Rα-Fc fusion proteins with and without engineered disulfide bonds based on Ki67 expression as measured by FACS.

Figure 43:
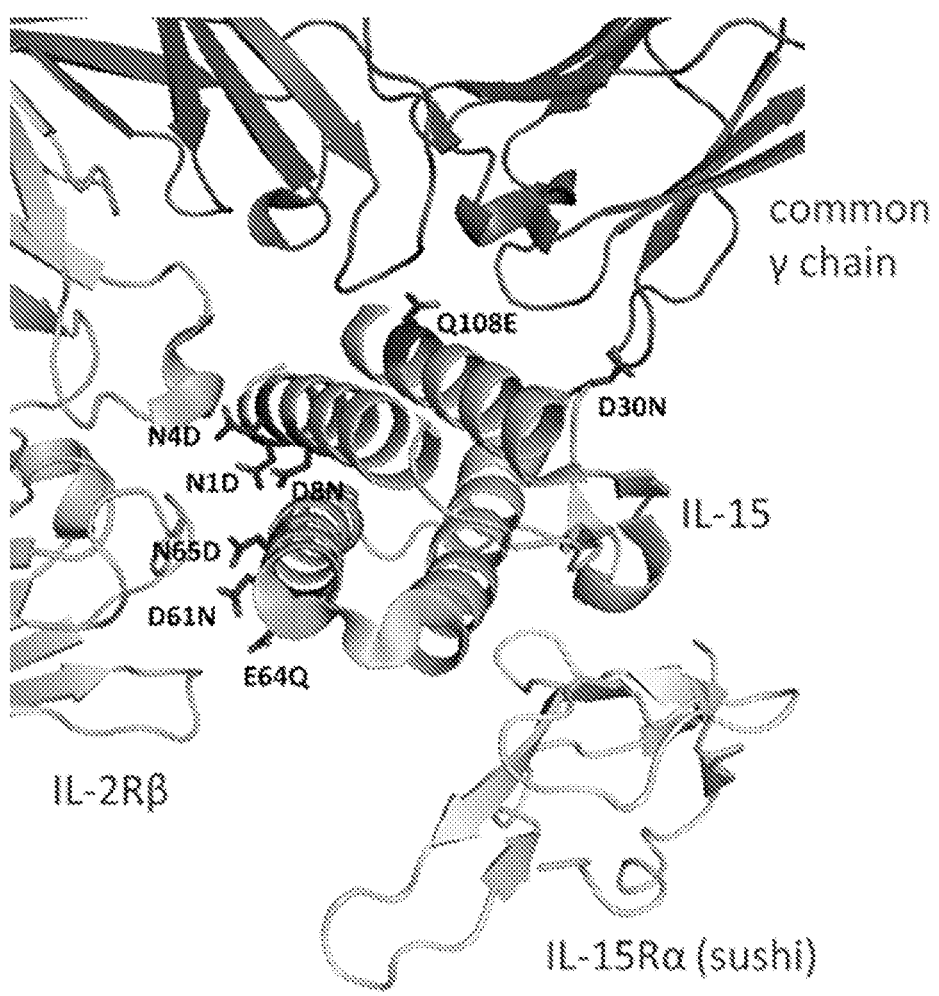

FIG. 43 depicts the structure of IL-15 complexed with IL-15Rα, IL-2Rß, and common gamma chain. Locations of substitutions designed to reduce potency are shown.

FIGS. 44A-44C depicts sequences for illustrative IL-15 variants engineered for reduced potency. Included within each of these variant IL-15 sequences are sequences that are 90, 95, 98 and 99% identical (as defined herein) to the recited sequences, and/or contain from 1, 2, 3, 4, 5, 6, 7, 8, 9 or 10 additional amino acid substitutions. In a non-limiting example, the recited sequences may contain additional amino acid modifications such as those contributing to formation of covalent disulfide bonds as described in Example 3B.

FIGS. 45A-45D depict sequences of XENP22821, XENP22822, XENP23554, XENP23557, XENP23561, XENP24018, XENP24019, XENP24045, XENP24051, and XENP24052, illustrative IL-15/Rα-Fc fusion proteins of the "IL-15/Rα-heteroFc" format engineered for reduced potency. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIGS. 46A-46C depict sequences of XENP24015, XENP24050, XENP24475, XENP24476, XENP24478, XENP24479, and XENP24481, illustrative IL-15/Rα-Fc fusion proteins of the "scIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

FIGS. 47A-47B depict sequences of XENP24349, XENP24890, and XENP25138, illustrative IL-15/Rα-Fc fusion proteins of the "ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, and Fc regions.

FIG. 48 depicts sequences of XENP22801 and XENP22802, illustrative ncIL-15/Rα heterodimers engineered for reduced potency. It is important to note that these sequences were generated using polyhistidine (His×6 (SEQ ID NO: 1221) or HHHHHH (SEQ ID NO: 1221)) C-terminal tags at the C-terminus of IL-15Rα(sushi).

FIG. 49 depicts sequences of XENP24342, an illustrative IL-15/Rα-Fc fusion protein of the "bivalent ncIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, and Fc regions.

FIG. 50 depicts sequences of XENP23472 and XENP23473, illustrative IL-15/Rα-Fc fusion proteins of the "dsIL-15/Rα-Fc" format engineered for reduced potency. IL-15 and IL-15Rα(sushi) are underlined, linkers are double underlined (although as will be appreciated by those in the art, the linkers can be replaced by other linkers, some of which are depicted in FIGS. 9 and 10), and slashes (/) indicate the border(s) between IL-15, IL-15Rα, linkers, and Fc regions.

Figure 51A:
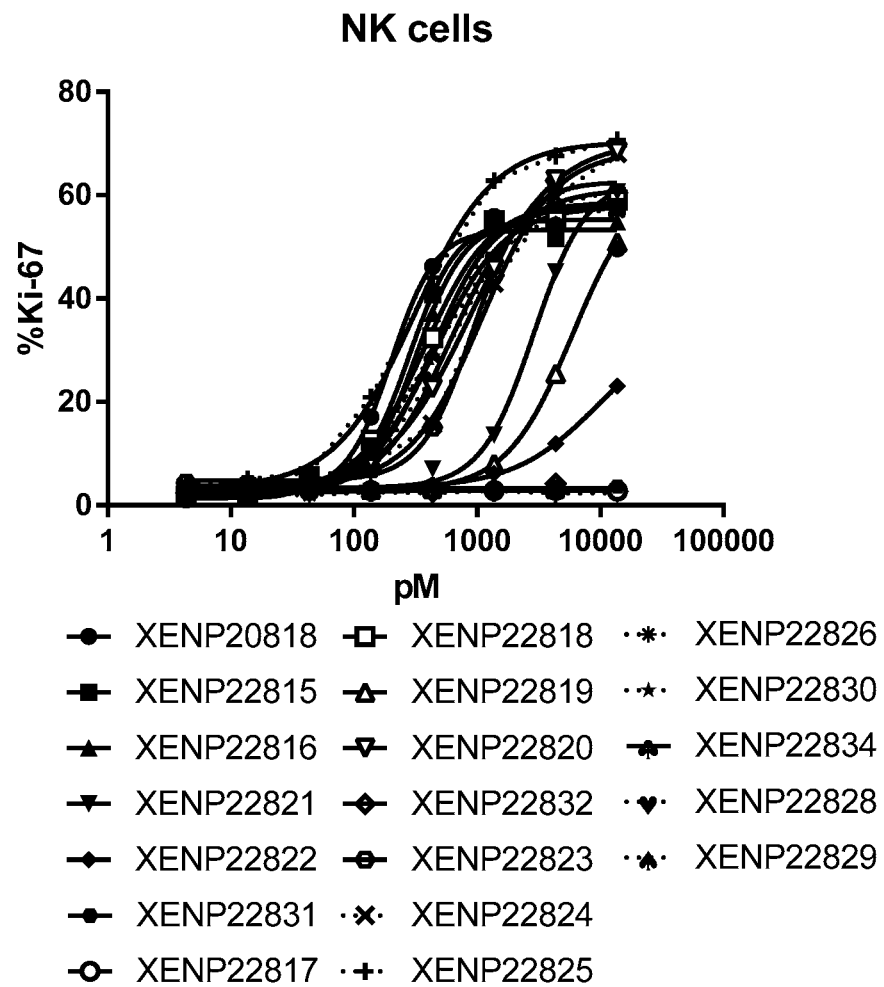
Figure 51B:
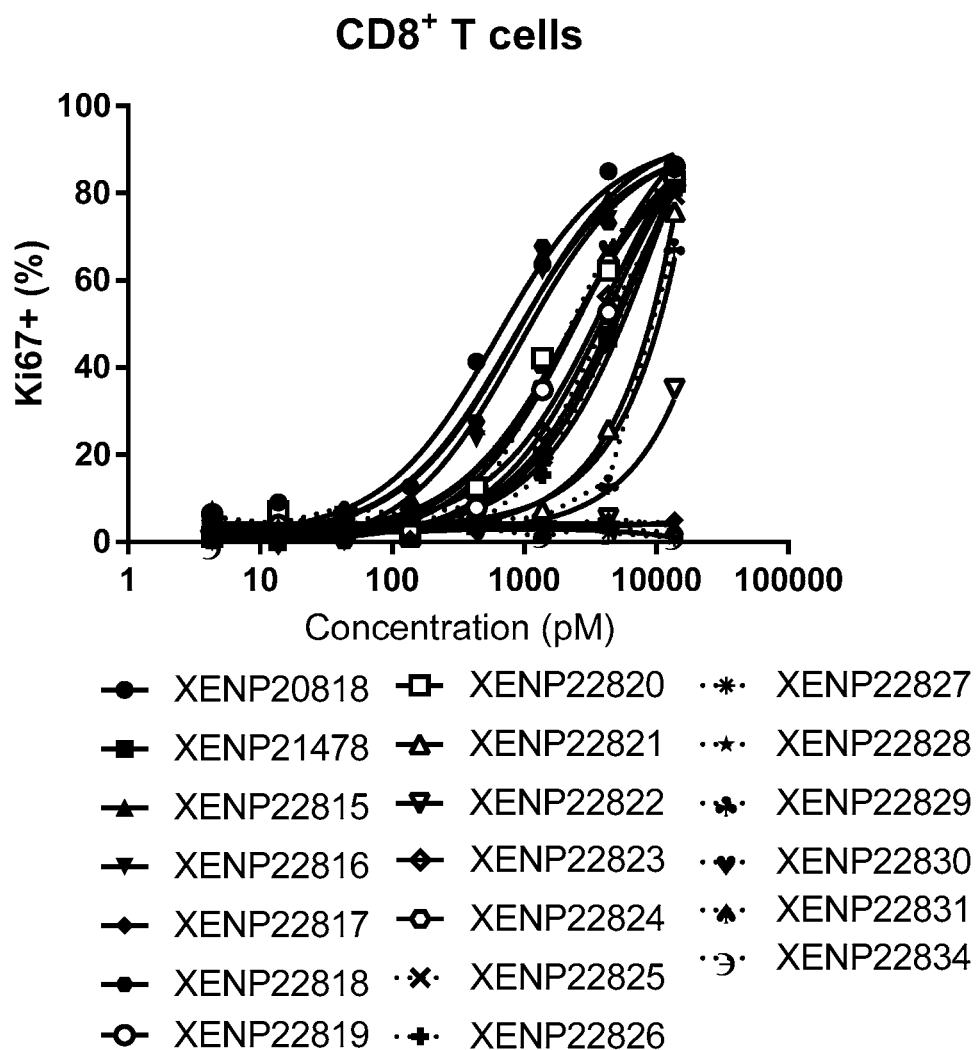
Figure 51C:
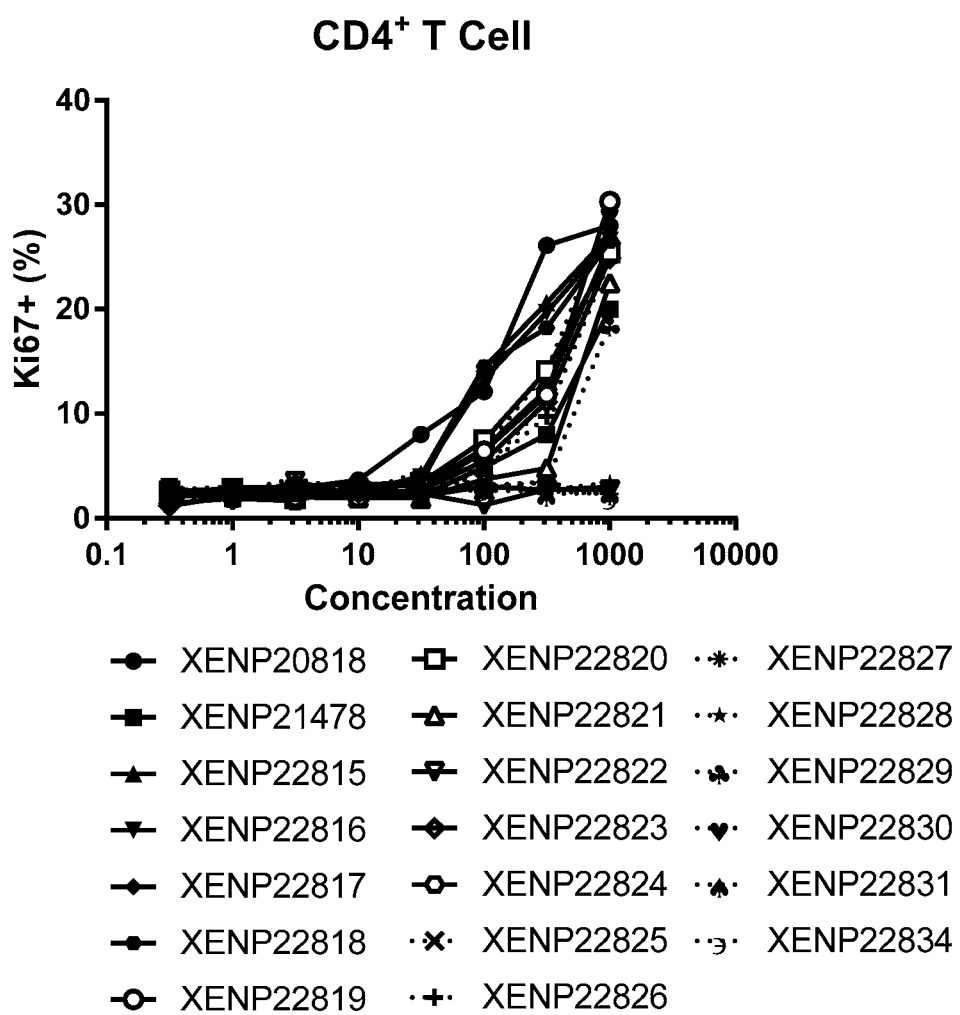

FIGS. 51A-51C depicts the induction of A) NK cell, B) CD8+ (CD45RA−) T cell, and C) CD4+ (CD45RA−) T cell proliferation by variant IL-15/Rα-Fc fusion proteins based on Ki67 expression as measured by FACS.

FIG. 52 depicts EC50 for induction of NK and CD8+ T cells proliferation by variant IL-15/Rα-Fc fusion proteins, and fold reduction in EC50 relative to XENP20818.

Figure 53A:
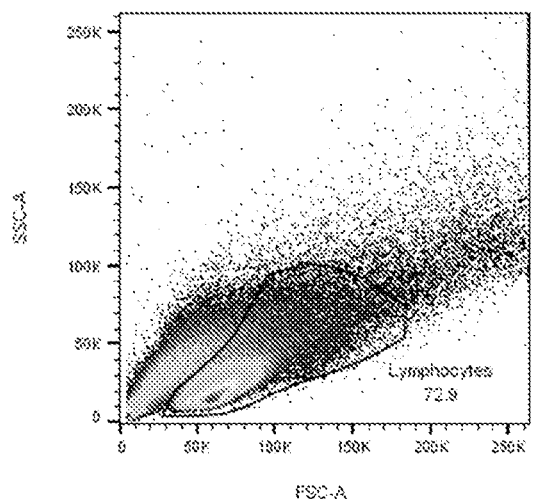
Figure 53B:
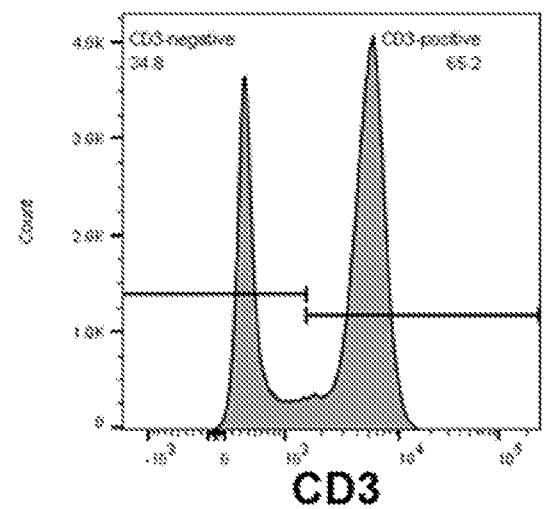
Figure 53C:
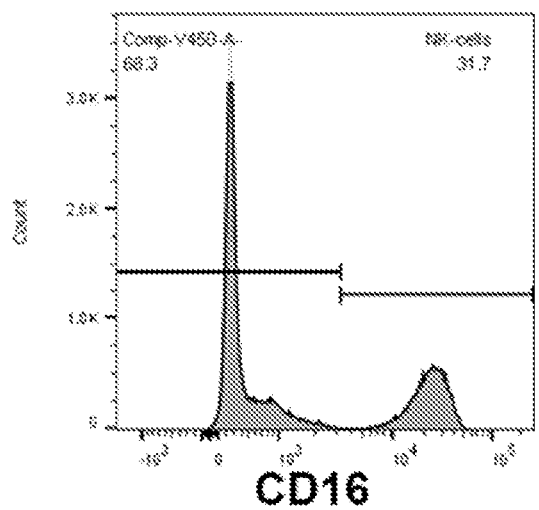

FIGS. 53A-53C depict the gating of lymphocytes and subpopulations for the experiments depicted in FIG. 56. FIG. 53A shows the gated lymphocyte population. FIG. 53B shows the CD3-negative and CD3-positive subpopulations. FIG. 53C shows the CD16=negative and CD16-positive subpopulations of the CD3-negative cells.

Figure 54A:
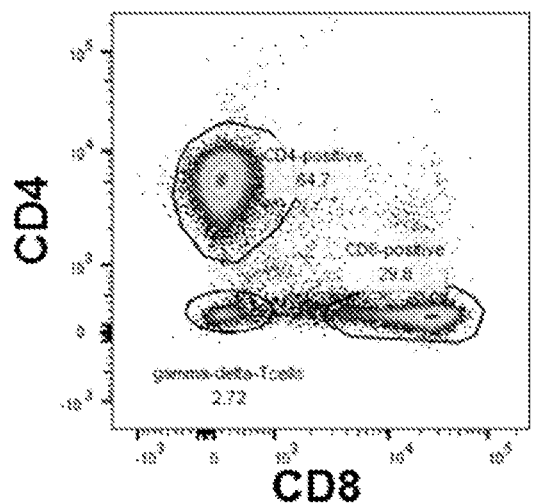
Figure 54B:
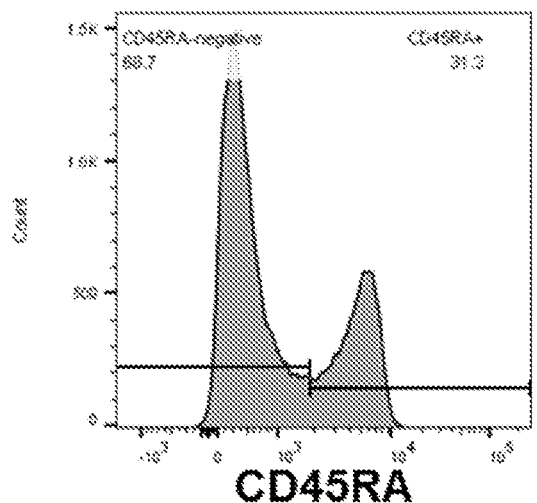
Figure 54C:
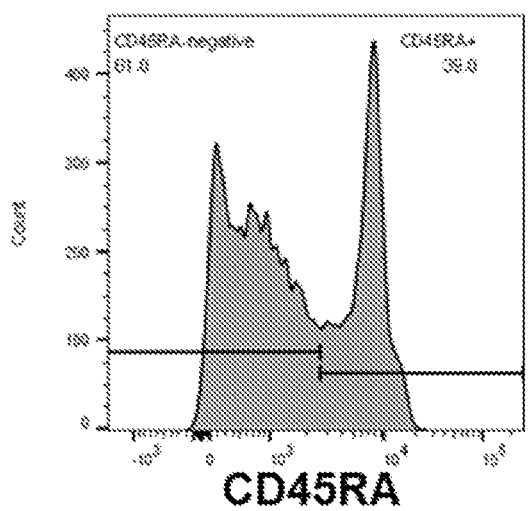

FIG. 54A-FIG. 54C depict the gating of CD3+ lymphocyte subpopulations for the experiments depicted in FIG. 56. FIG. 54A shows the CD4+, CD8+ and γδ T cell subpopulations of the CD3+ T cells. FIG. 54B shows the CD45RA(−) and CD45RA(+) subpopulations of the CD4+ T cells. FIG. 54C shows the CD45RA(−) and CD45RA(+) subpopulations of the CD8+ T cells.

Figure 55A:
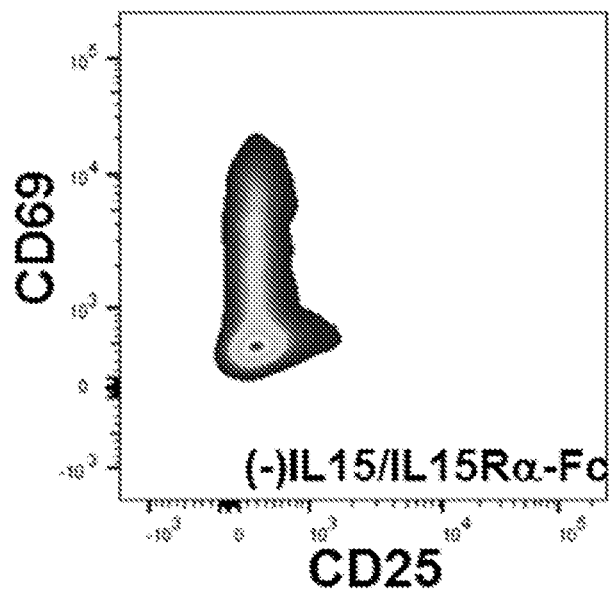
Figure 55B:
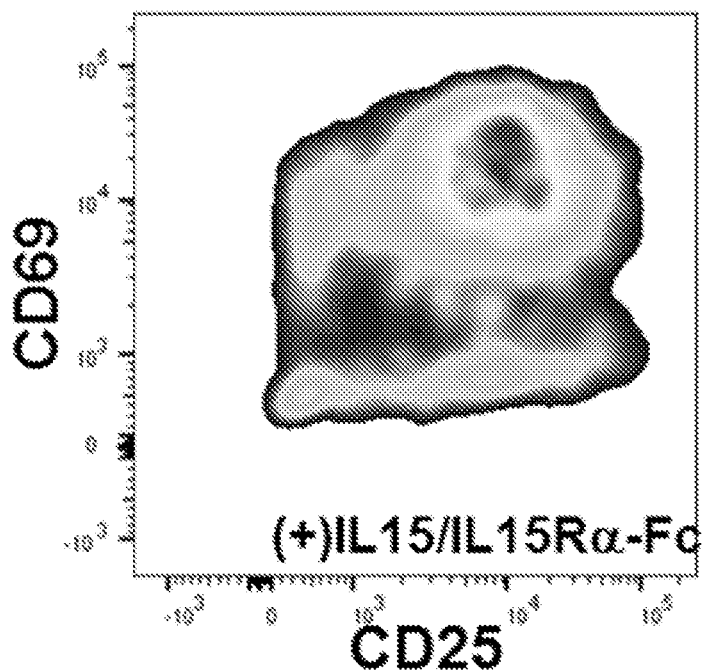

FIGS. 55A-55B depict CD69 and CD25 expression before (FIG. 55A) and after (FIG. 55B) incubation of human PBMCs with XENP22821.

Figure 56A:
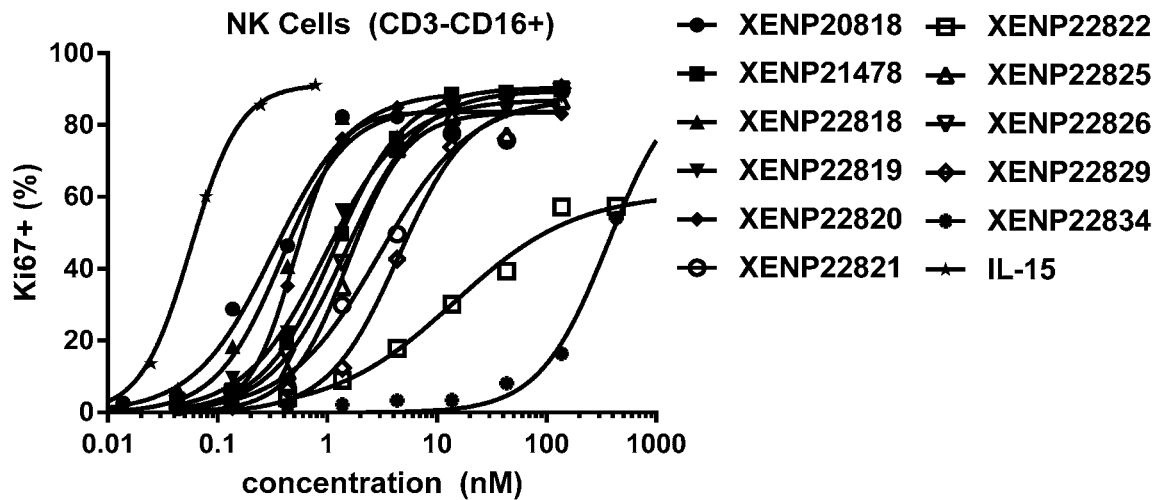
Figure 56B:
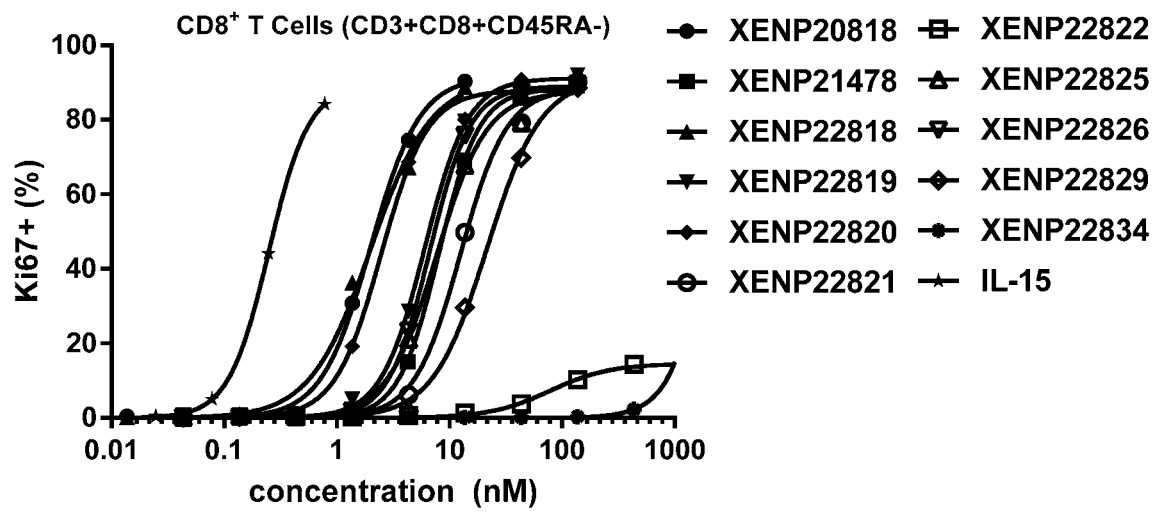
Figure 56C:
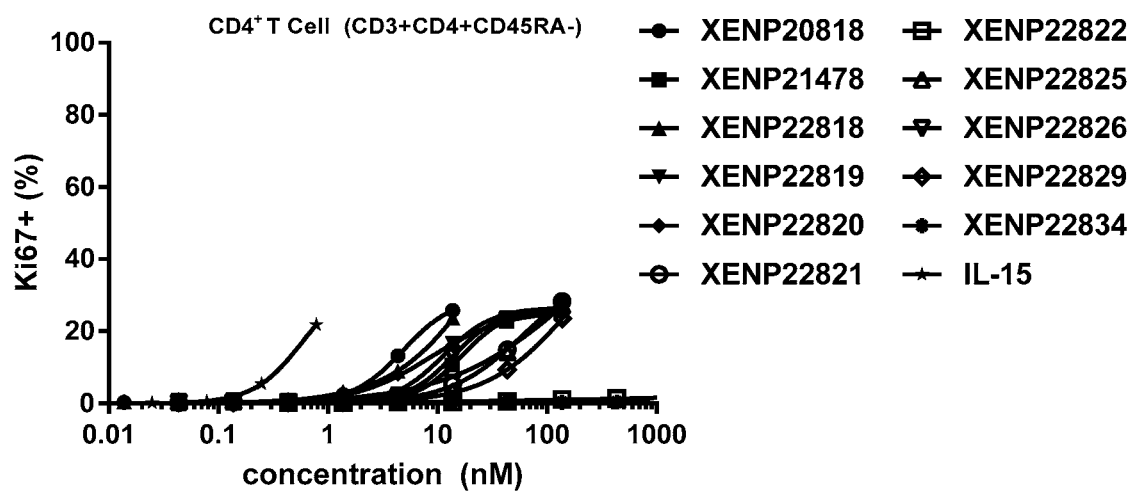

FIGS. 56A-56D depict cell proliferation in human PBMCs incubated for four days with the indicated variant IL-15/Rα-Fc fusion proteins. FIGS. 56A-56C show the percentage of proliferating NK cells (CD3−CD16+) (FIG. 56A), CD8+ T cells (CD3+CD8+CD45RA−) (FIG. 56B) and CD4+ T cells (CD3+CD4+CD45RA−) (FIG. 56C). FIG. 56D shows the fold change in EC50 of various IL15/IL15Rα Fc heterodimers relative to control (XENP20818).

Figure 57A:
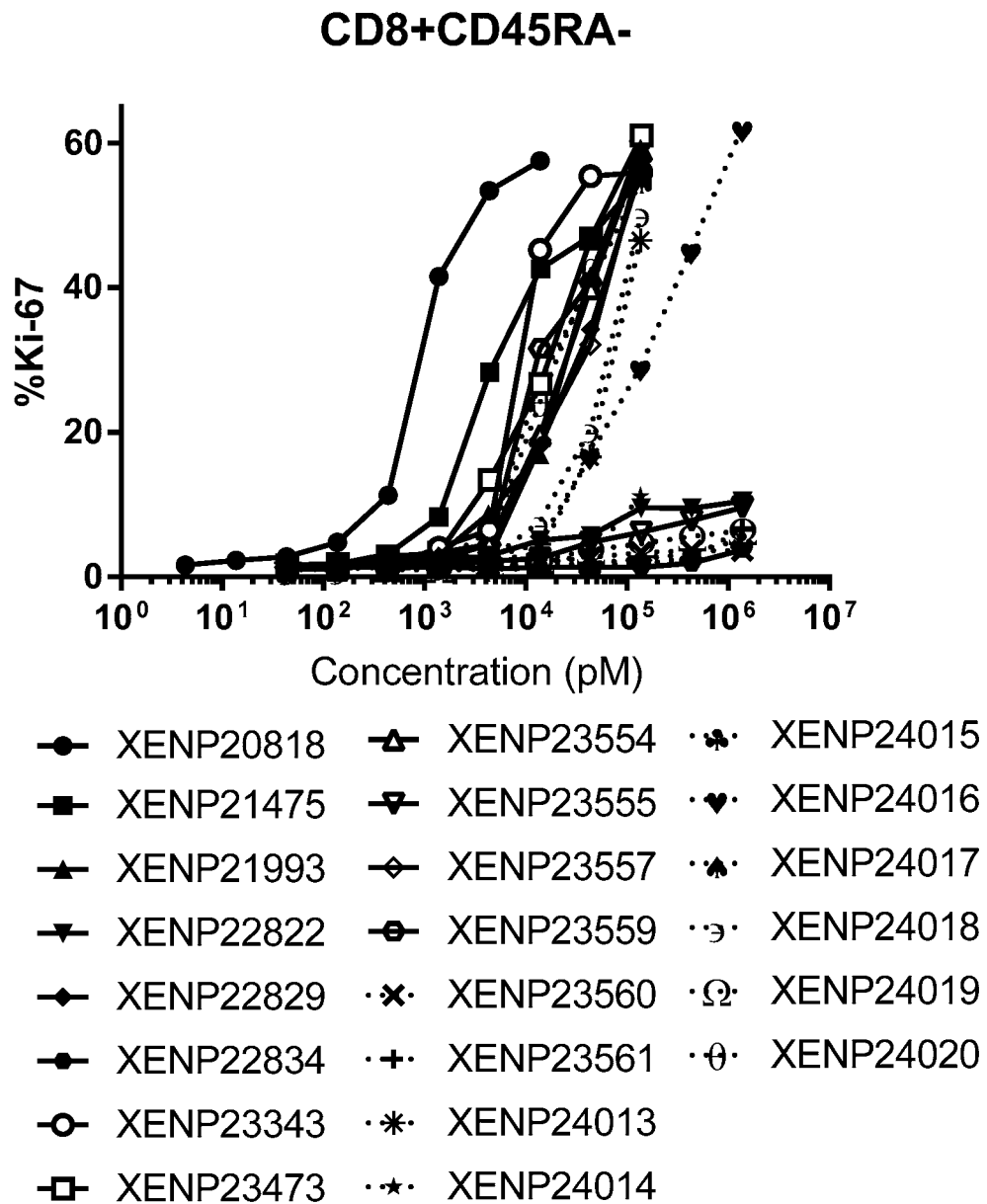
Figure 57B:
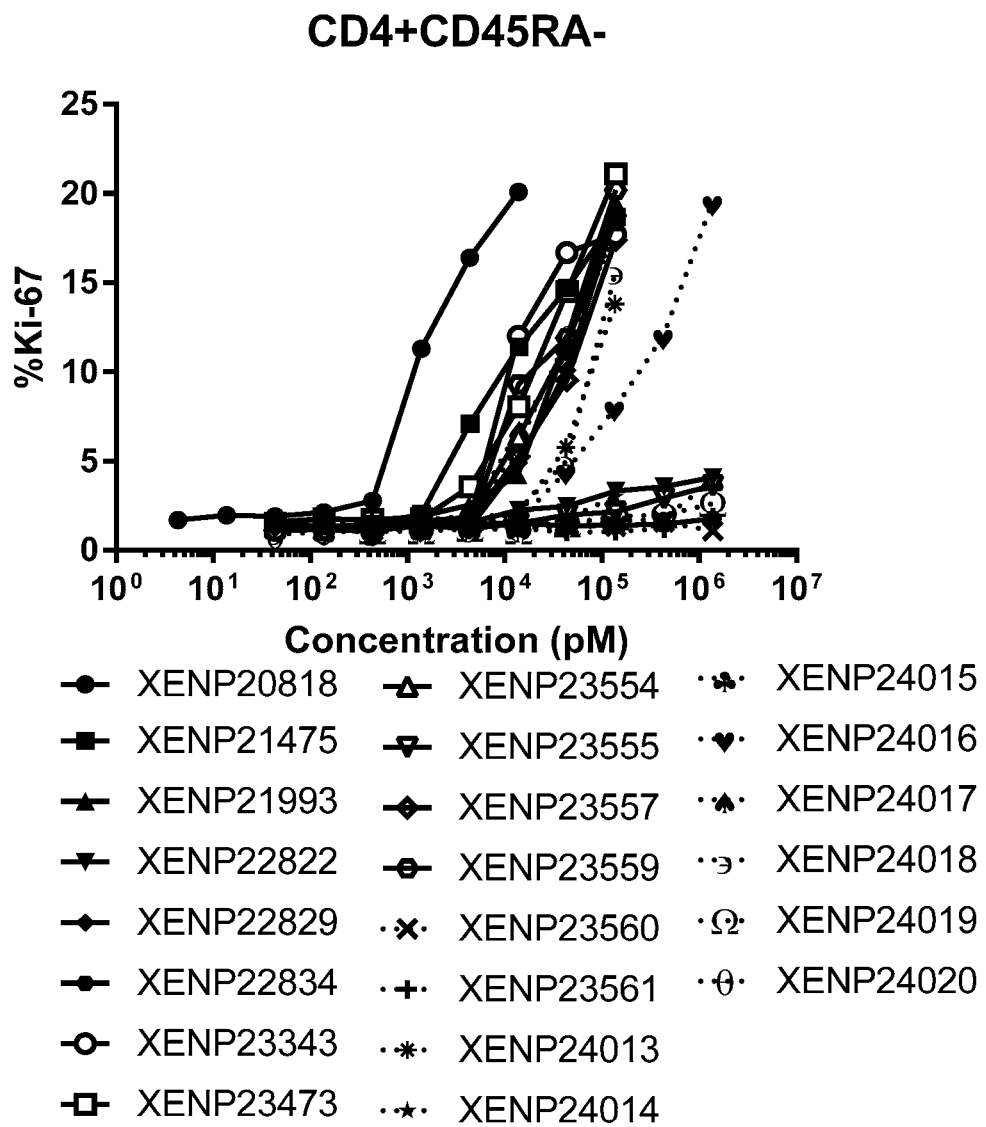
Figure 57C:
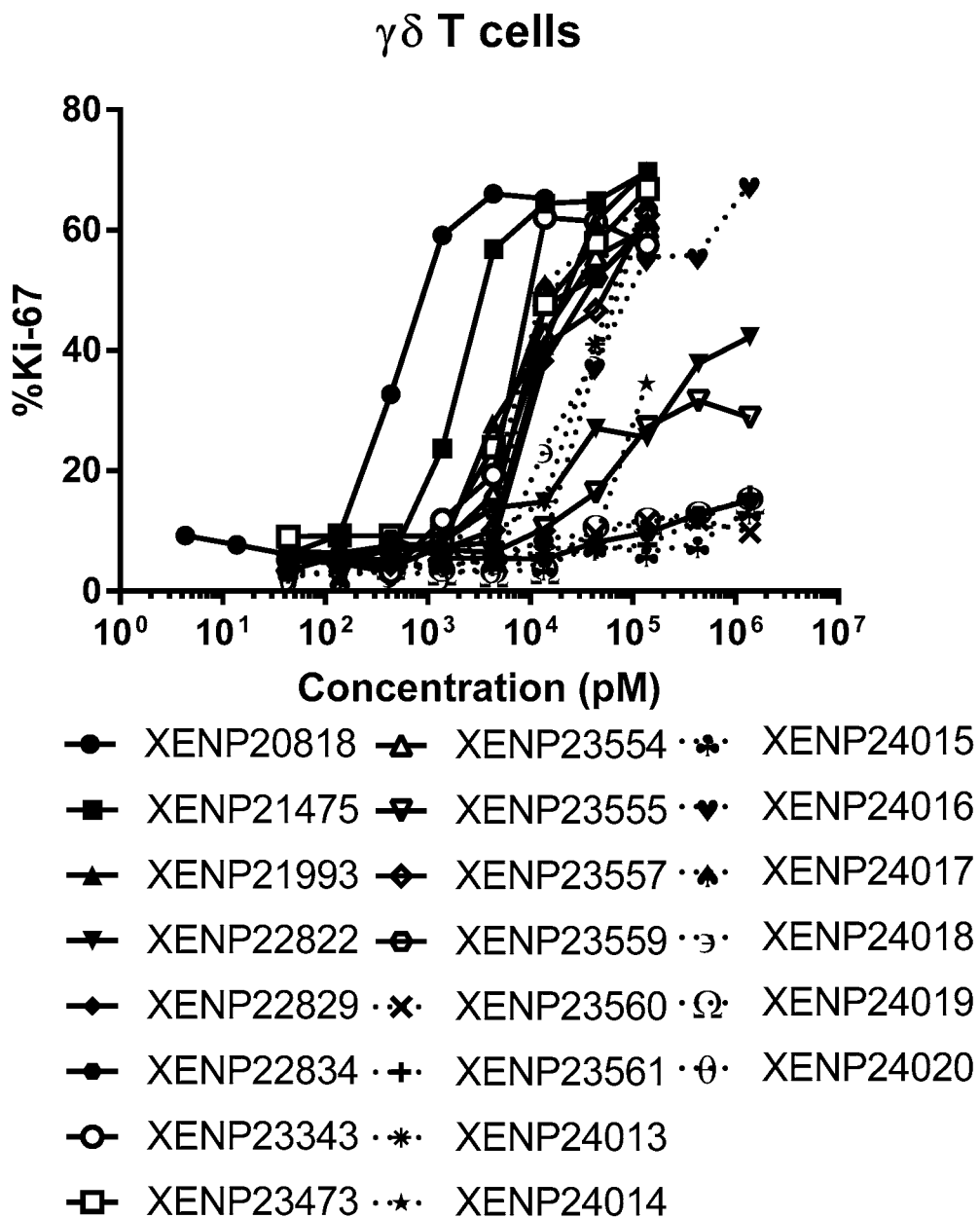
Figure 57D:
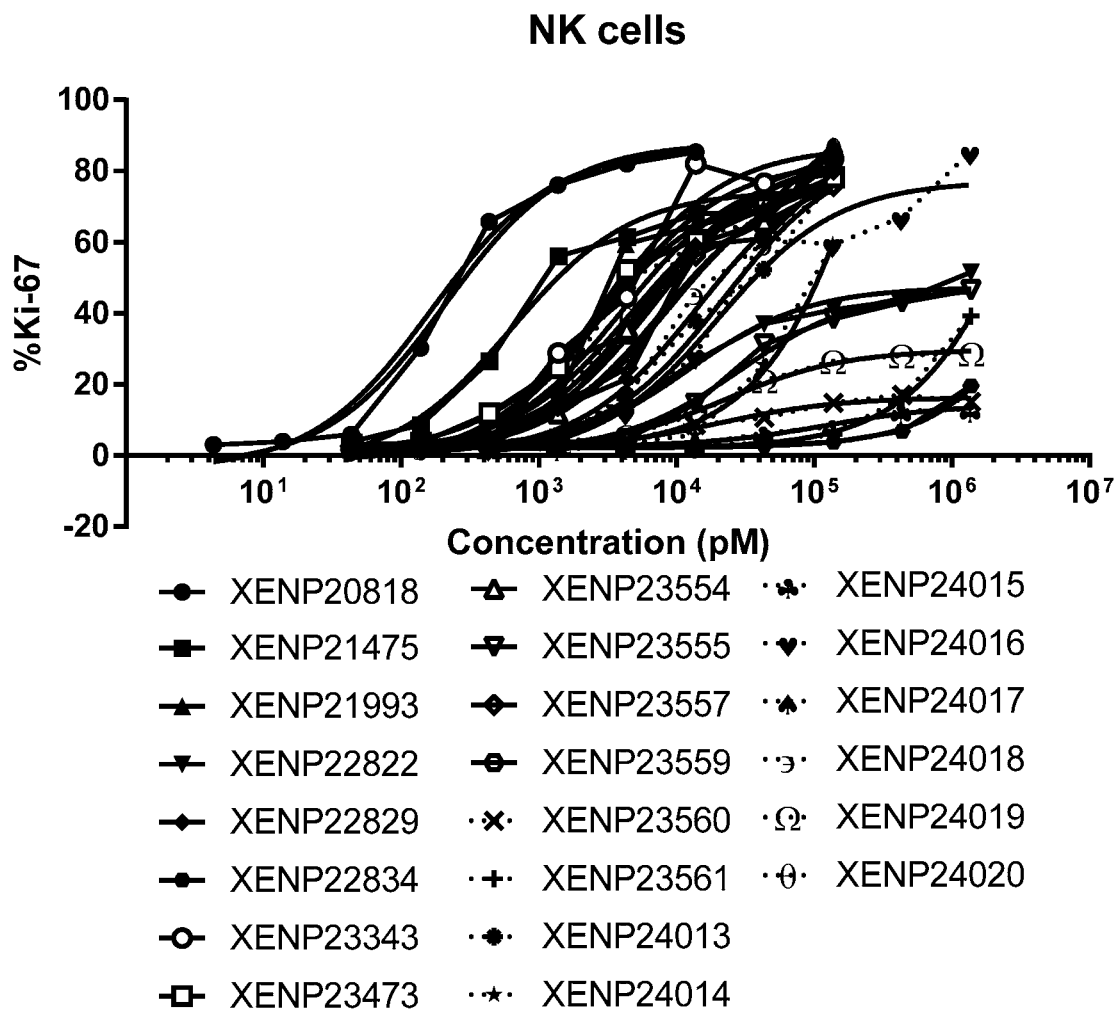

FIGS. 57A-57D depict cell proliferation in human PBMCs incubated for three days with the indicated variant IL-15/Rα-Fc fusion proteins. FIGS. 57A-C show the percentage of proliferating CD8+ (CD45RA−) T cells (FIG. 57A), CD4+ (CD45RA−) T cells (FIG. 57B), γδ T cells (FIG. 57C), and NK cells (FIG. 57D).

Figure 58A:
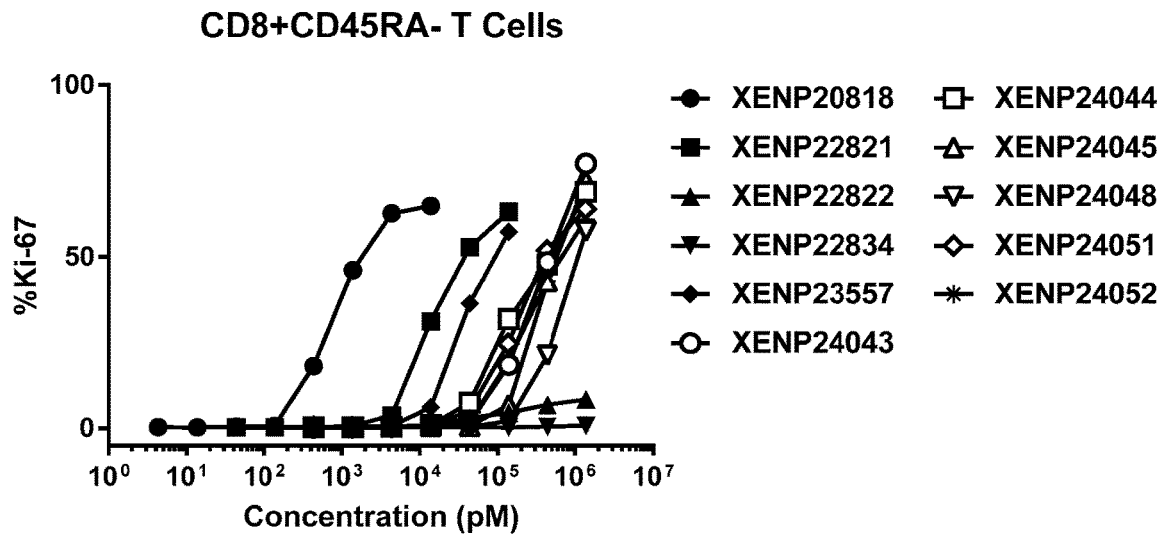
Figure 58B:
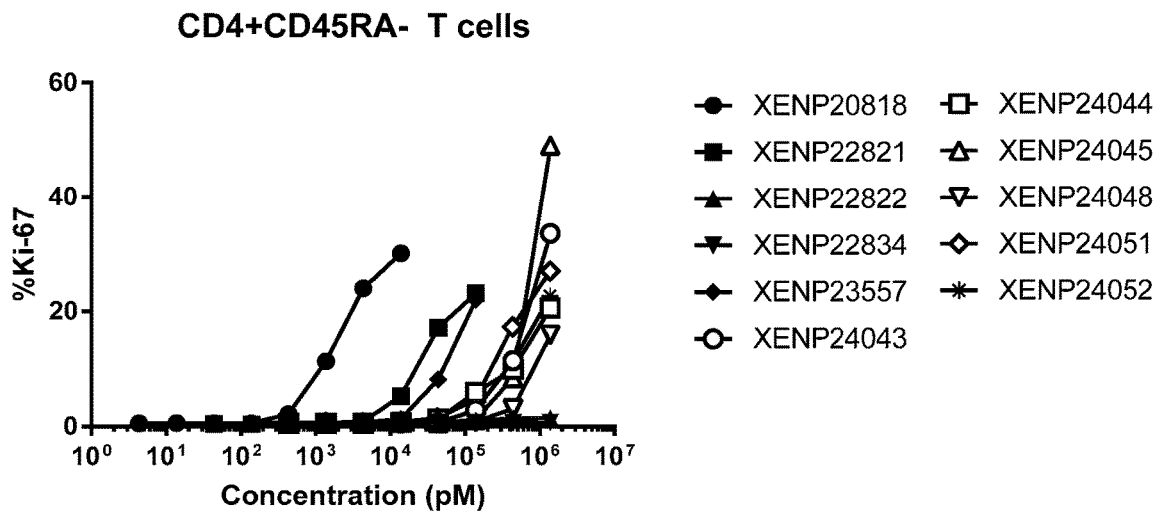
Figure 58C:
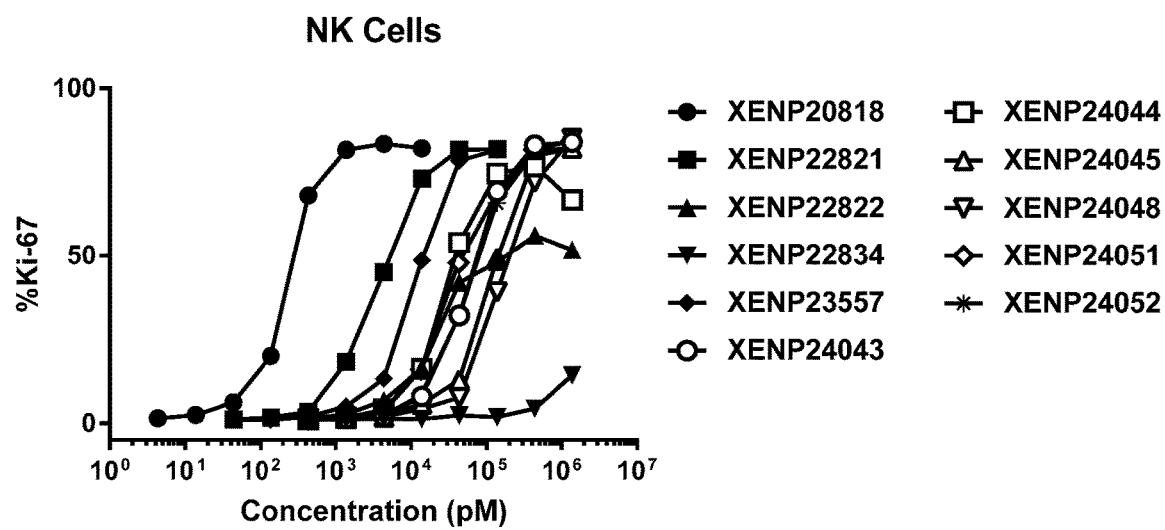
Figure 59A:
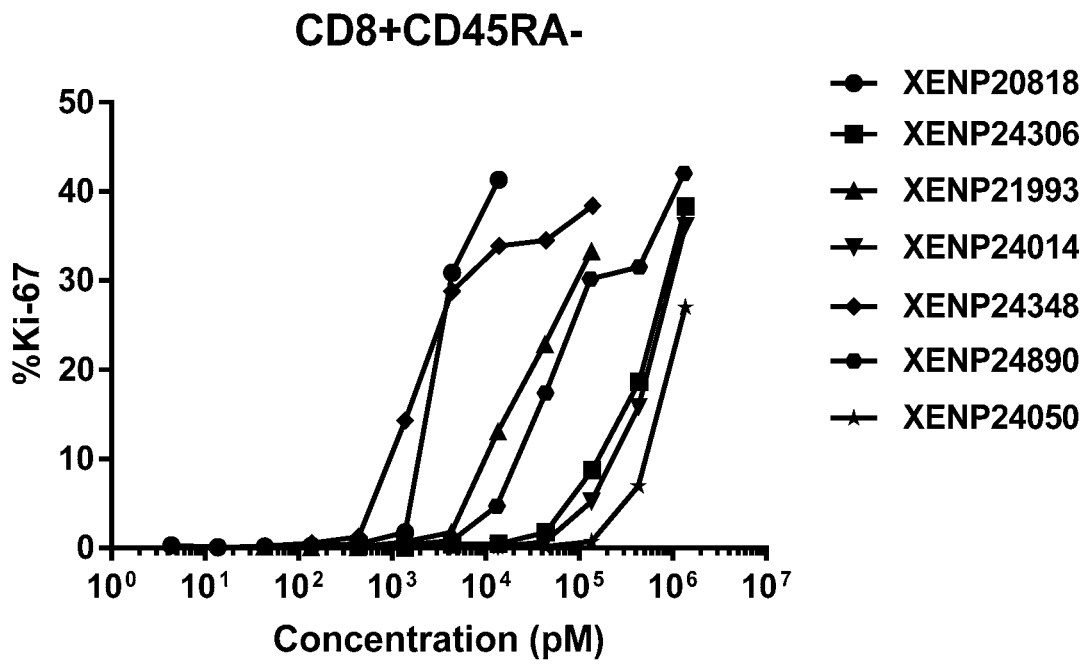
Figure 59B:
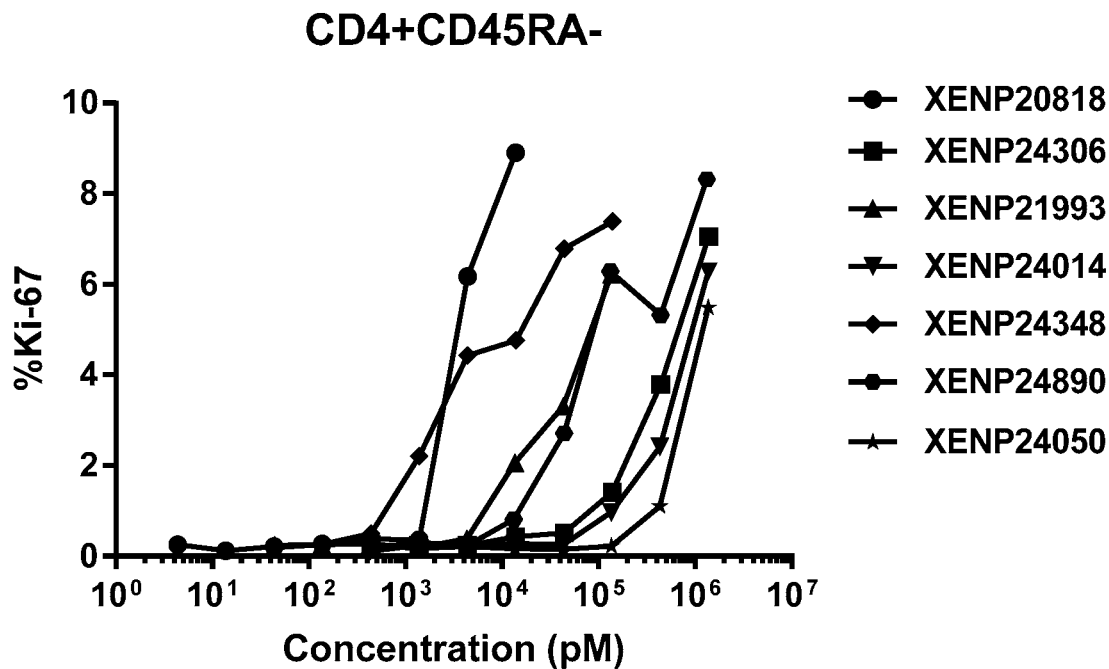
Figure 59C:
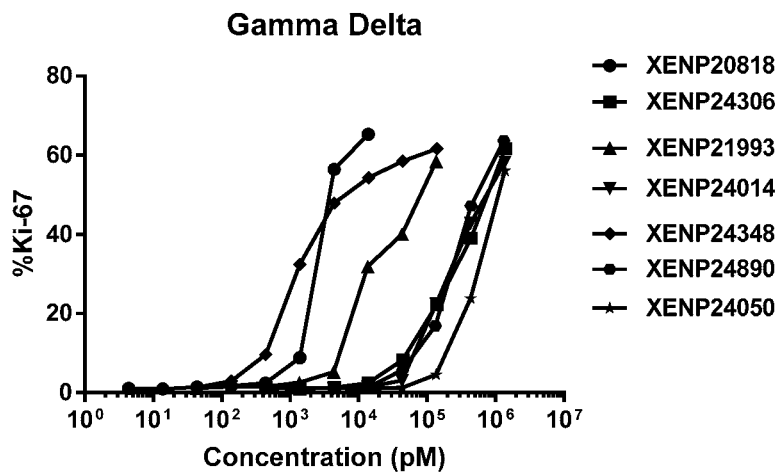
Figure 59D:
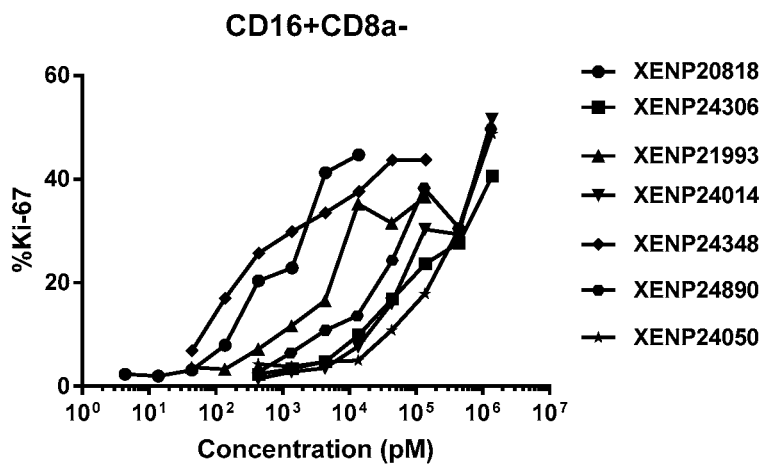
Figure 59E:
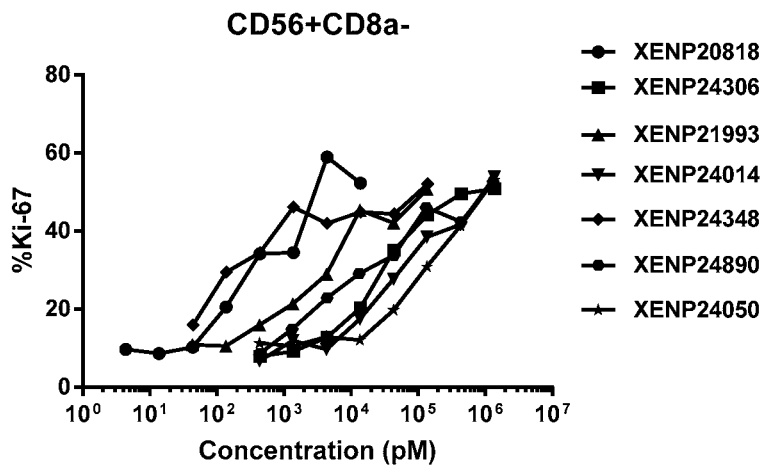
Figure 60A:
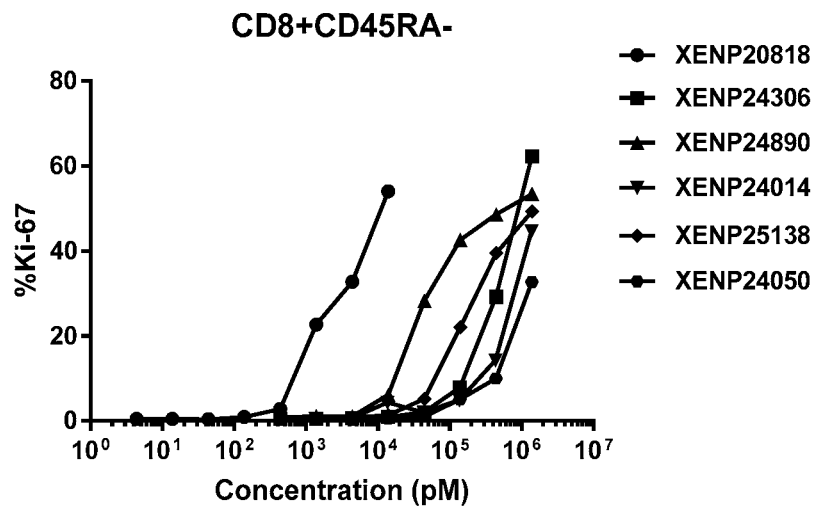
Figure 60B:
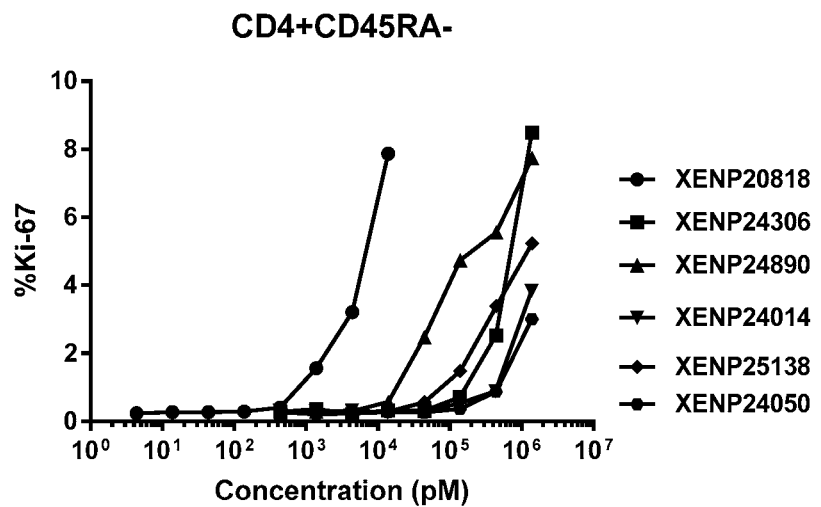
Figure 60C:
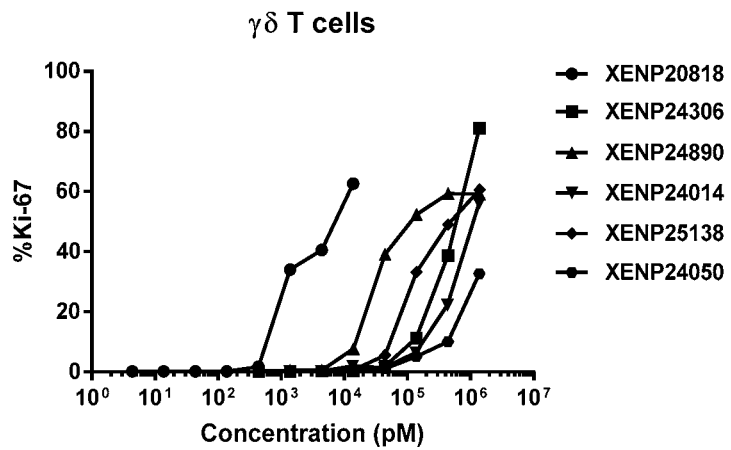
Figure 60D:
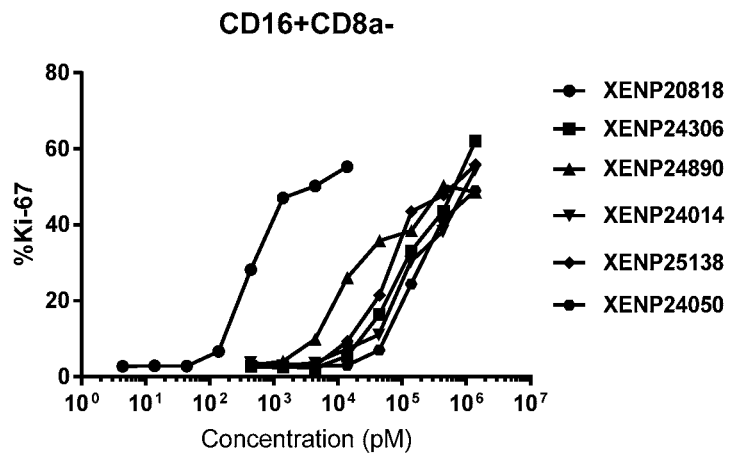
Figure 60E:
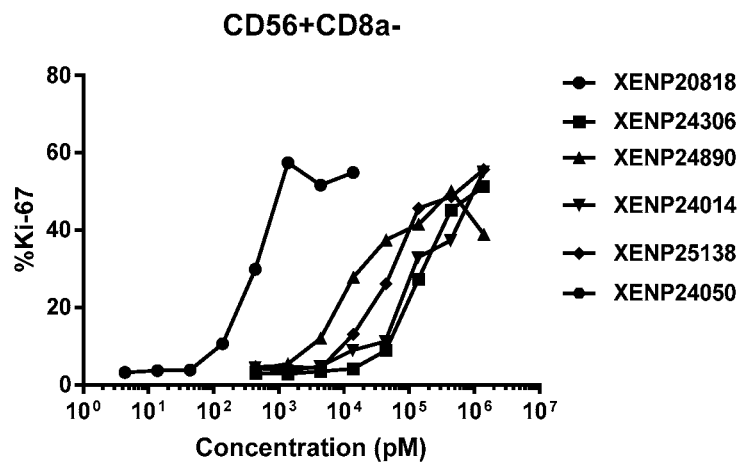
Figure 61A:
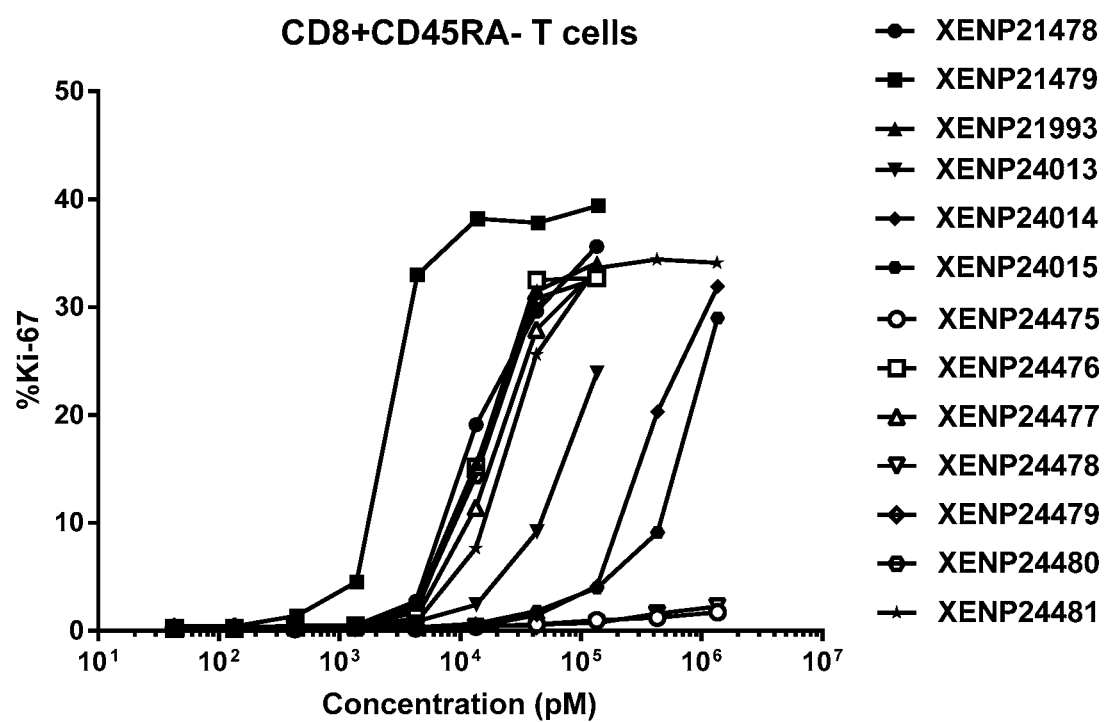
Figure 61B:
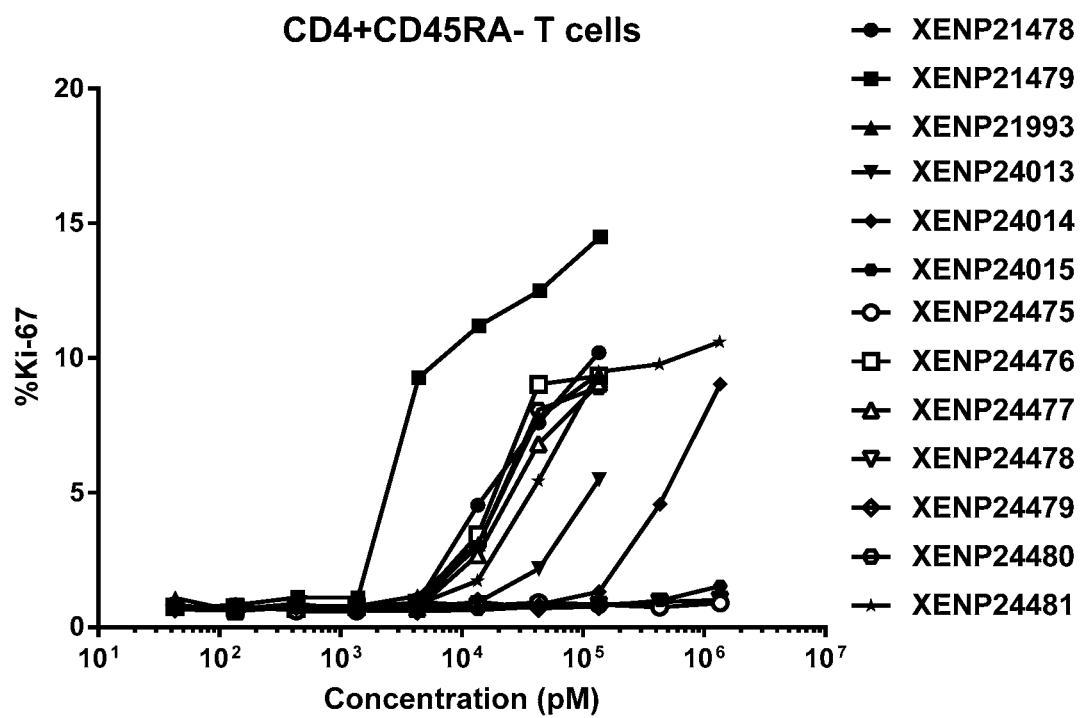
Figure 61C:
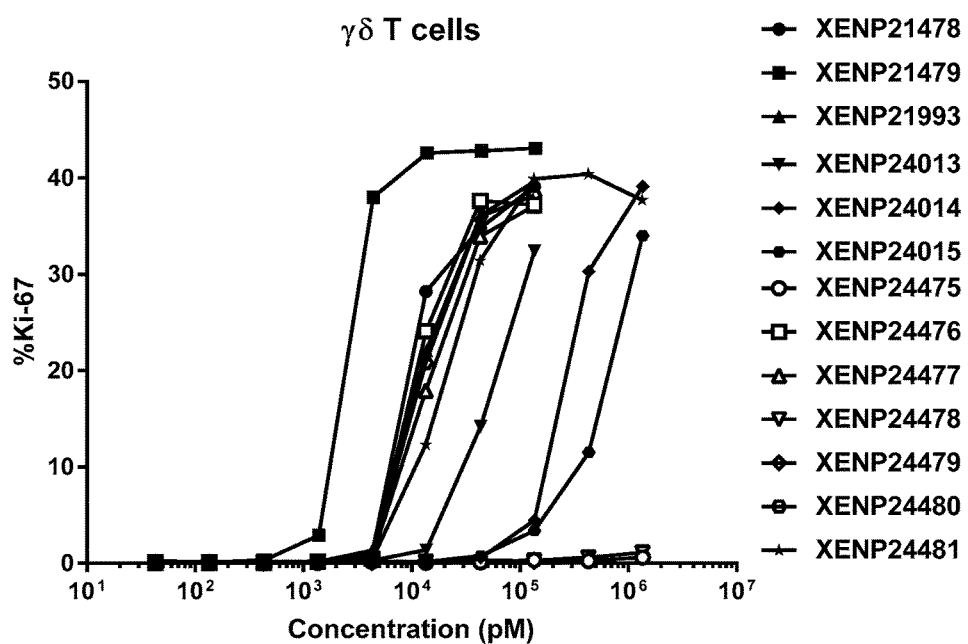
Figure 61D:
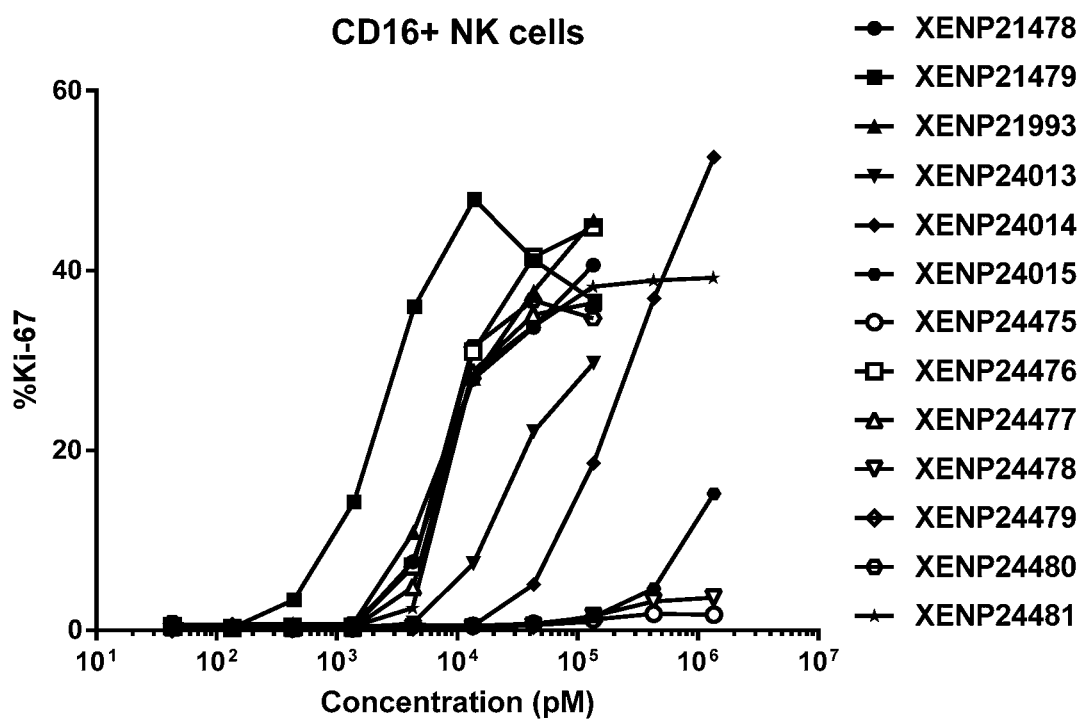
Figure 62A:
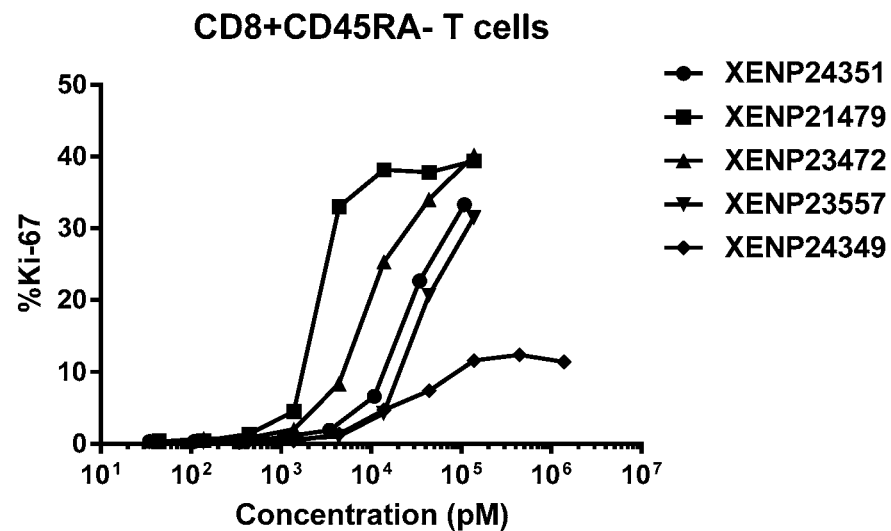
Figure 62B:
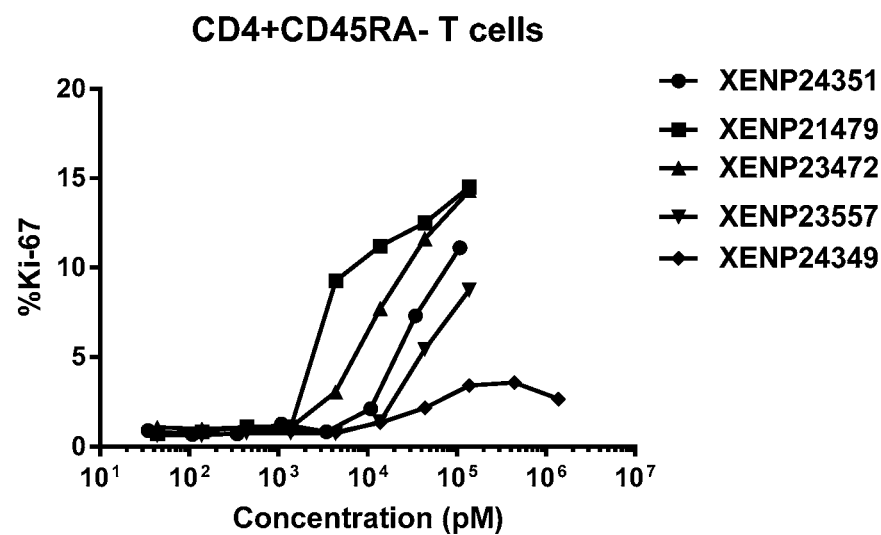
Figure 62C:
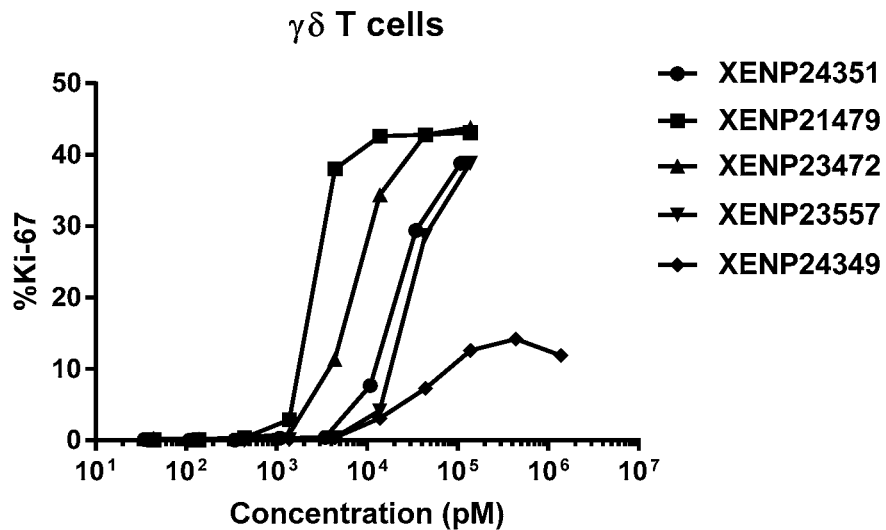
Figure 62D:
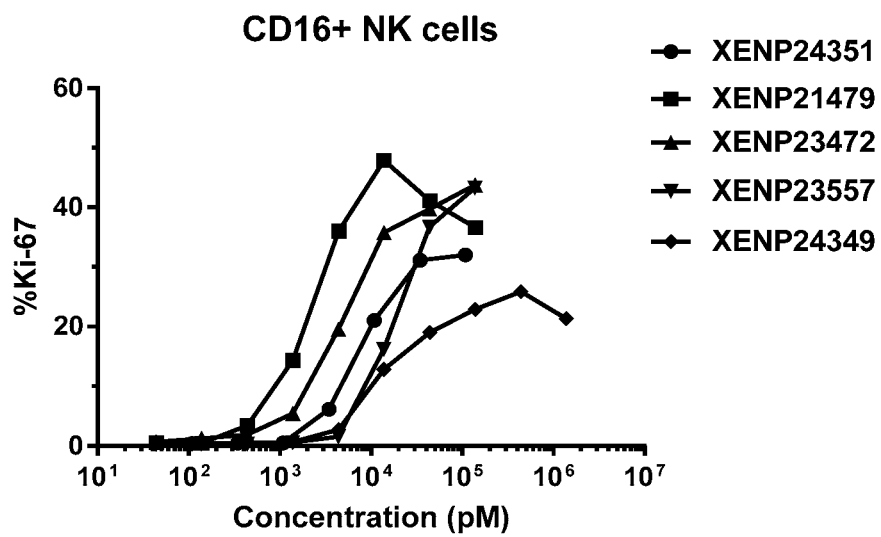

FIGS. 58A-58C depict the percentage of Ki67 expression on (FIG. 58A) CD8+ T cells, (FIG. 58B) CD4+ T cells, and (FIG. 58C) NK cells following treatment with additional IL-15/Rα variants.

FIGS. 59A-59E depict the percentage of Ki67 expression on (FIG. 59A) CD8+ (CD45RA−) T cells, (FIG. 59B) CD4+ (CD45RA−) T cells, (FIG. 59C) γδ T cells, (FIG. 59D) NK (CD16+CD8α−) cells, and (FIG. 59E) NK (CD56+CD8α−) cells following treatment with IL-15/Rα variants.

FIGS. 60A-60E depict the percentage of Ki67 expression on (FIG. 60A) CD8+ (CD45RA−) T cells, (FIG. 60B) CD4+ (CD45RA−) T cells, (FIG. 60C) γδ T cells, (FIG. 60D) NK (CD16+CD8α−) cells, and (FIG. 60E) NK (CD56+CD8α−) cells following treatment with IL-15/Rα variants.

FIGS. 61A-61D depict the percentage of Ki67 expression on (FIG. 61A) CD8+ T cells, (FIG. 61B) CD4+ T cells, (FIG. 61C) γδ T cells and (FIG. 61D) NK (CD16+) cells following treatment with additional IL-15/Rα variants.

FIGS. 62A-62D depict the percentage of Ki67 expression on (FIG. 62A) CD8+ T cells, (FIG. 62B) CD4+ T cells, (FIG. 62C) γδ T cells and (FIG. 62D) NK (CD16+) cells following treatment with additional IL-15/Rα variants.

Figure 63:
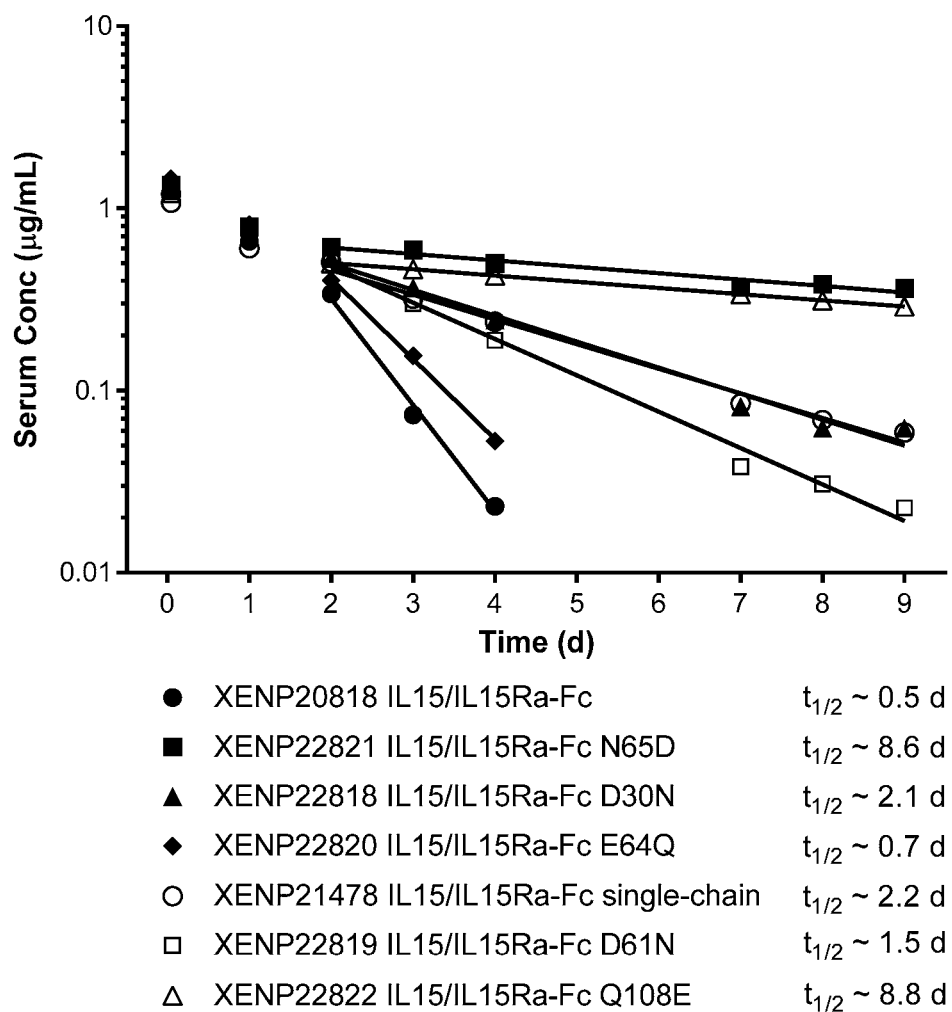

FIG. 63 depicts IV-TV Dose PK of various IL-15/Rα Fc fusion proteins or controls in C57BL/6 mice at 0.1 mg/kg single dose.

Figure 64:
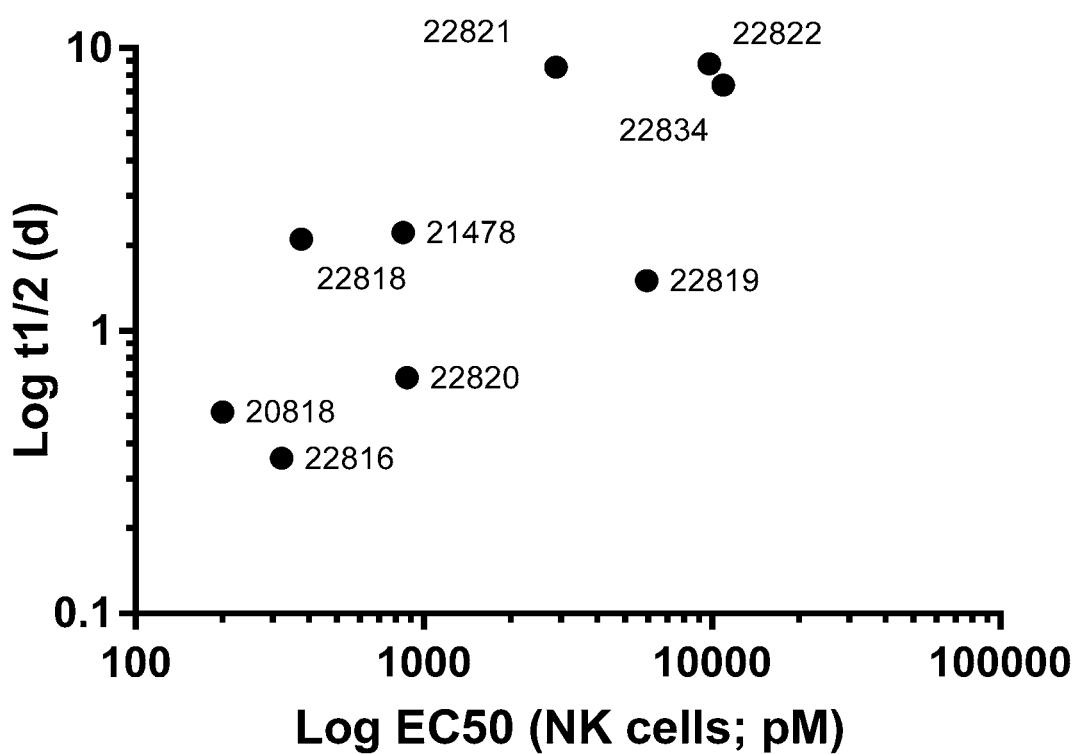

FIG. 64 depicts the correlation of half-life vs NK cell potency following treatment with IL-15/Rα-Fc fusion proteins engineered for lower potency.

FIGS. 65A-65K depict several formats for the PD-1-targeted IL-15/Rα-Fc fusion proteins of the present invention. The "scIL-15/RαxscFv" format (FIG. 65A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. The "scFvxncIL-15/Rα" format (FIG. 65B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. The "scFvxdsIL-15/Rα" format (FIG. 65C) is the same as the "scFvxncIL-15/Rα" format, but wherein IL-15Rα(sushi) and IL-15 are covalently linked as a result of engineered cysteines. The "scIL-15/RαxFab" format (FIG. 65D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. The "ncIL-15/RαxFab" format (FIG. 65E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. The "dsIL-15/RαxFab" format (FIG. 65F) is the same as the "ncIL-15/RαxFab" format, but wherein IL-15Rα(sushi) and IL-15 are covalently linked as a result of engineered cysteines. The "mAb-scIL-15/Rα" format (FIG. 65G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form Fabs with the VHs. The "mAb-ncIL-15/Rα" format (FIG. 65H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. The "mAb-dsIL-15/Rα" format (FIG. 65I) is the same as the "mAb-ncIL-15/Rα" format, but wherein IL-15Rα(sushi) and IL-15 are covalently linked as a result of engineered cysteines. The "central-IL-15/Rα" format (FIG. 65J) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. The "central-scIL-15/Rα" format (FIG. 65K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form a Fabs with the VHs.

FIG. 66 depicts sequences of XENP21480, an illustrative PD-1-targeted IL-15/Rα-Fc fusion protein of the "scIL-15/RαxscFv" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIG. 67 depicts sequences of an illustrative PD-1-targeted IL-15/Rα-Fc fusion protein of the "scFvxncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIG. 68 depicts sequences of an illustrative PD-1-targeted IL-15/Rα-Fc fusion protein of the "scFvxdsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant Fc regions.

FIGS. 69A-69C depict sequences of illustrative PD-1-targeted IL-15/Rα-Fc fusion proteins of the "scIL-15/Rαx Fab" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant Fc regions.

FIG. 70 depicts sequences of XENP22112, an illustrative PD-1-targeted IL-15/Rα-Fc fusion protein of the "Fabx ncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant Fc regions.

FIG. 71 depicts sequences of XENP22641, an illustrative PD-1-targeted IL-15/Rα-Fc fusion protein of the "Fabx dsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIGS. 72A-72B depict sequences of an illustrative PD-1-targeted IL-15/Rα-Fc fusion protein of the "mAbxscIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIGS. 73A-73B depict sequences of XENP22642 and XENP22643, illustrative PD-1-targeted IL-15/Rα-Fc fusion proteins of the "mAbxncIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIGS. 74A-74B depicts sequences of XENP22644 and XENP22645, illustrative PD-1-targeted IL-15/Rα-Fc fusion proteins of the "mAbxdsIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIG. 75 depicts sequences of illustrative PD-1-targeted IL-15/Rα-Fc fusion proteins of the "central-IL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

FIG. 76 depicts sequences of illustrative PD-1-targeted IL-15/Rα-Fc fusion proteins of the "central-scIL-15/Rα" format. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions.

Figure 77D:
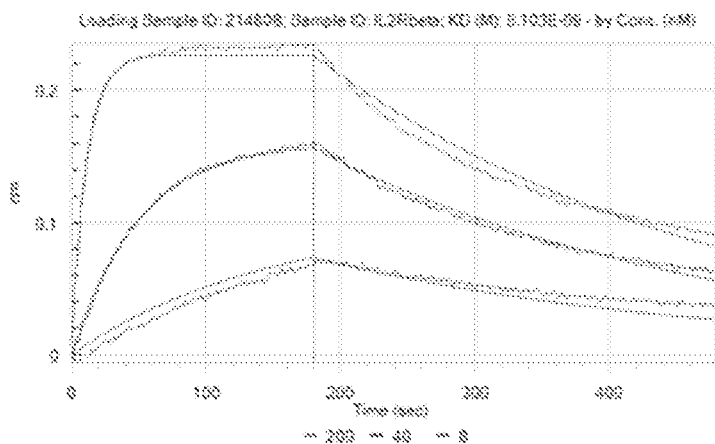
Figure 77E:
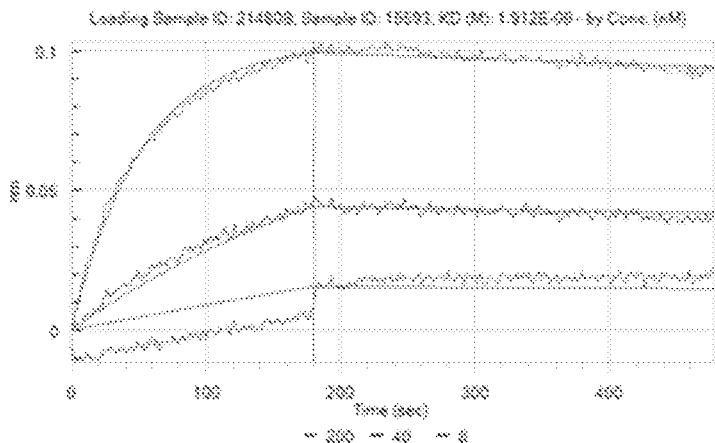
Figure 77F:
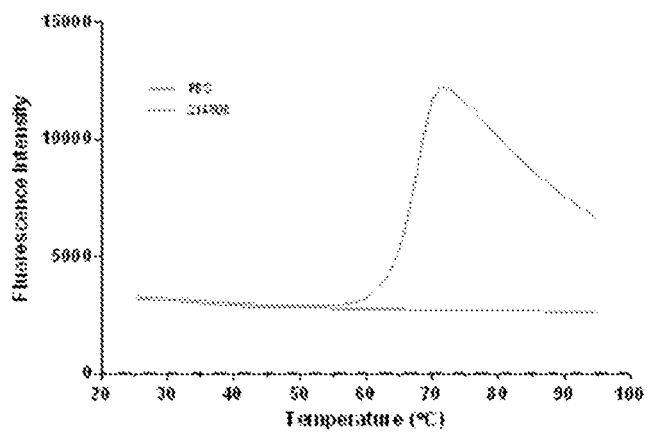

FIGS. 77A-77F provide data for an illustrative PD-1-targeted IL-15/Rα-Fc fusion protein XENP21480. FIG. 77A depicts the format for an illustrative PD-1 targeted IL-15/Rα-Fc fusion protein XENP21480. FIG. 77B depicts the purity and homogeneity of XENP21480 as determined by SEC. FIG. 77C depicts the purity and homogeneity of XENP21480 as determined by CEF. FIG. 77D depicts the affinity of XENP21480 for IL-2Rβ as determined by Octet. FIG. 77E depicts the affinity of XENP21480 for PD-1 as determined by Octet. FIG. 77F depicts the stability of XENP21480 as determined by DSF.

Figure 78A:
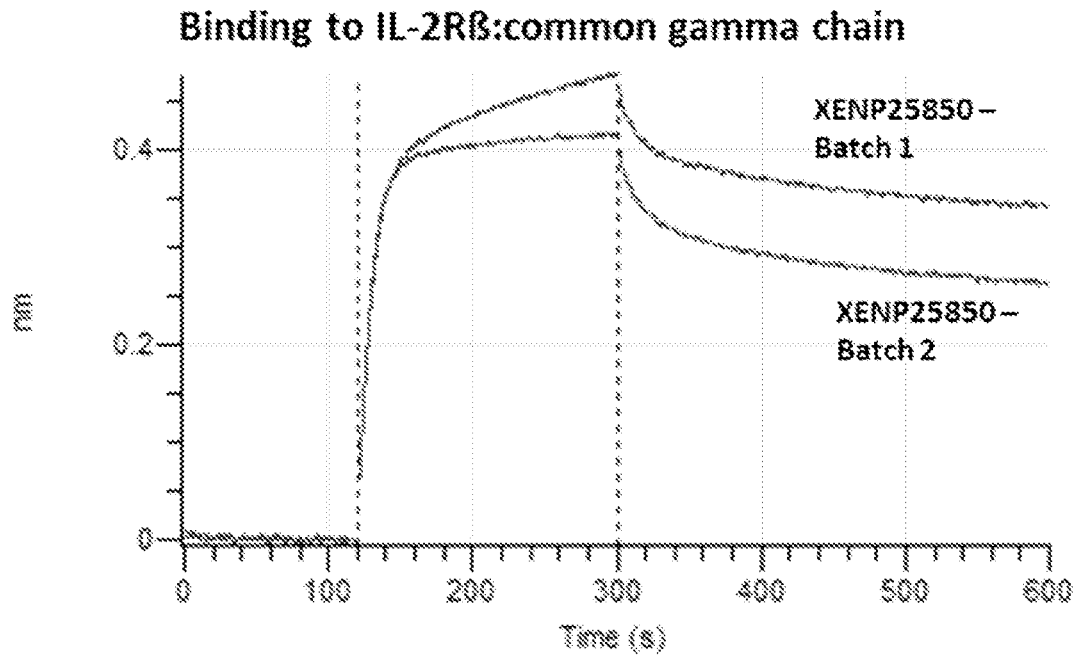
Figure 78B:
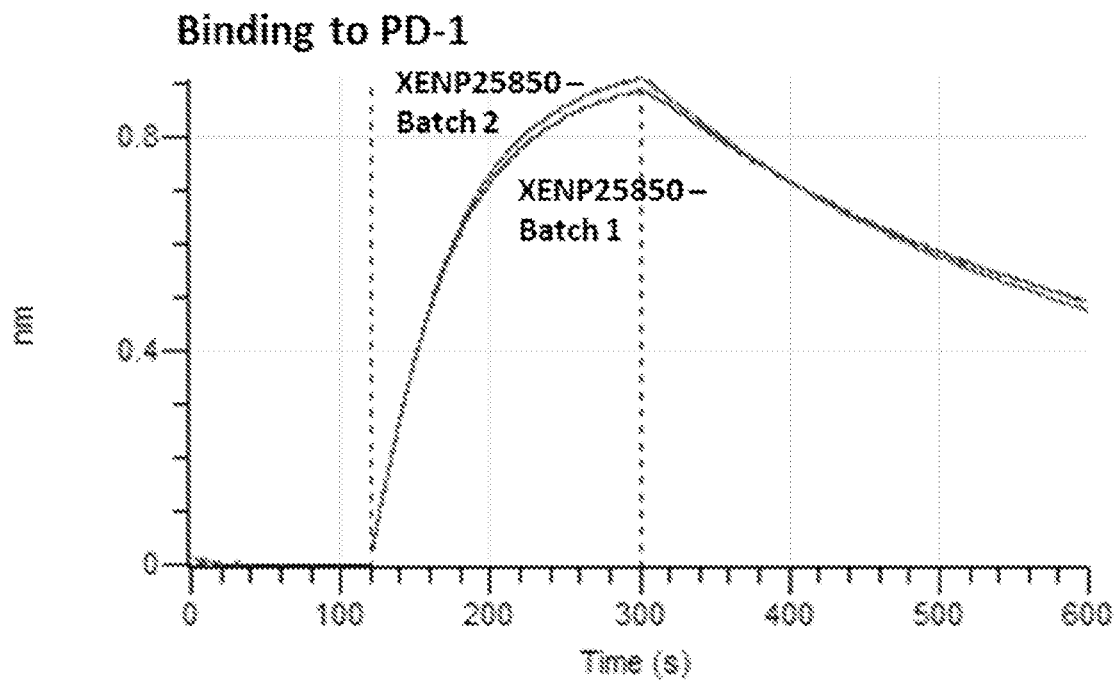

FIGS. 78A-78B depict the sensorgrams from Octet experiment for confirming the binding of two batches of XENP25850 to IL-2Rß:common gamma chain complex (FIG. 78A) and PD-1 (FIG. 78B).

Figure 79A:
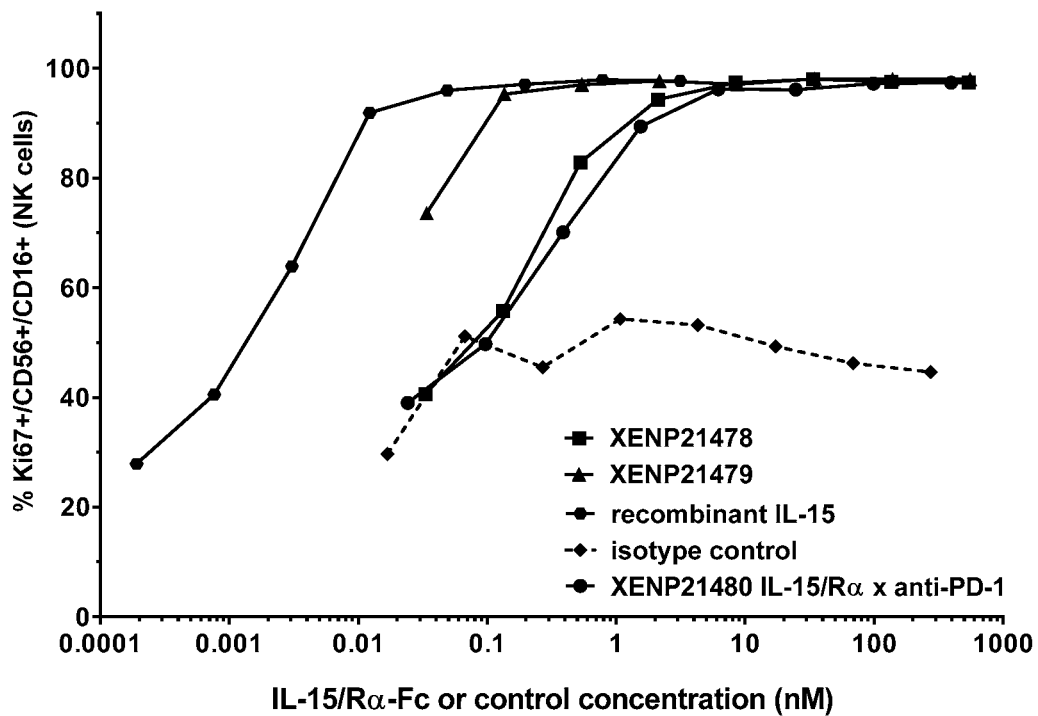
Figure 79B:
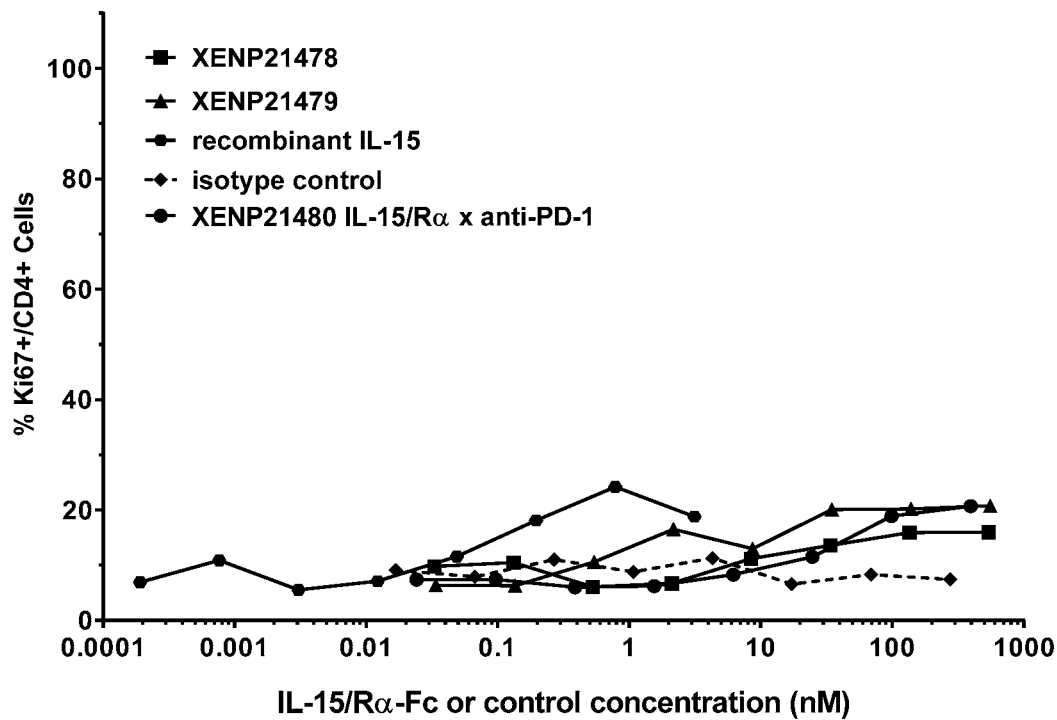
Figure 79C:
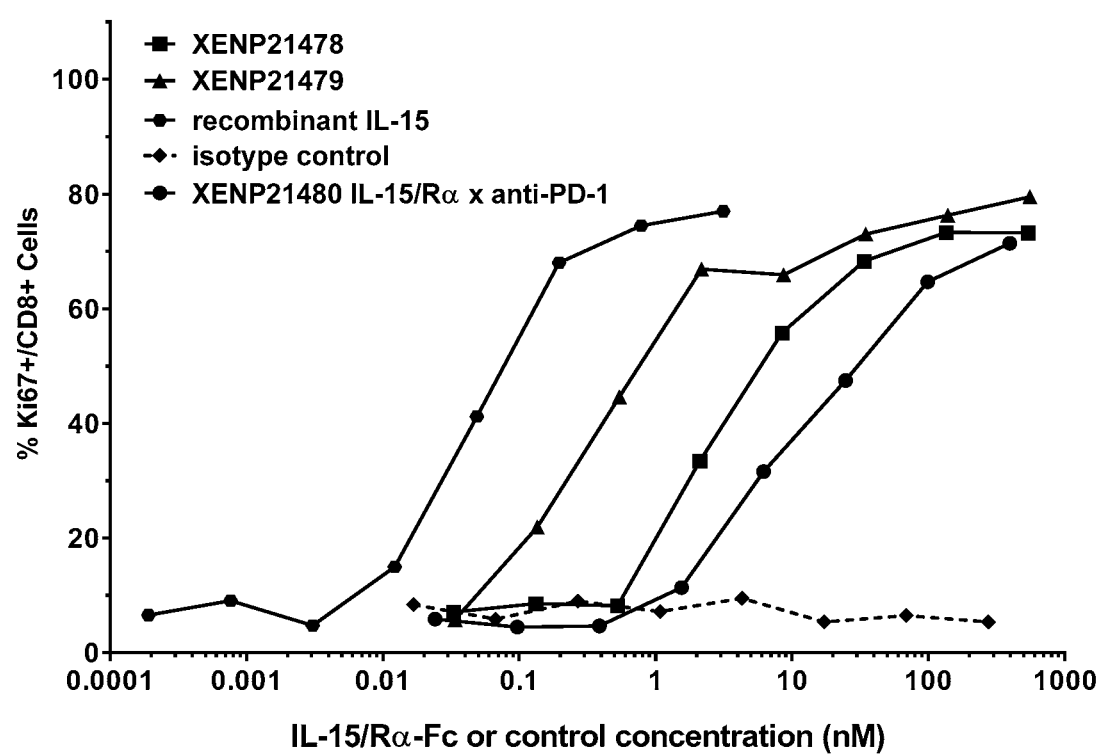

FIGS. 79A-79C depict the induction of NK ($CD56^+$/$CD16^+$) cells (FIG. 79A), $CD4^+$ T cells (FIG. 79B), and $CD8^+$ T cells (FIG. 79C) proliferation by illustrative PD-1 targeted IL-15/Rα-Fc fusion proteins and controls.

Figure 80:
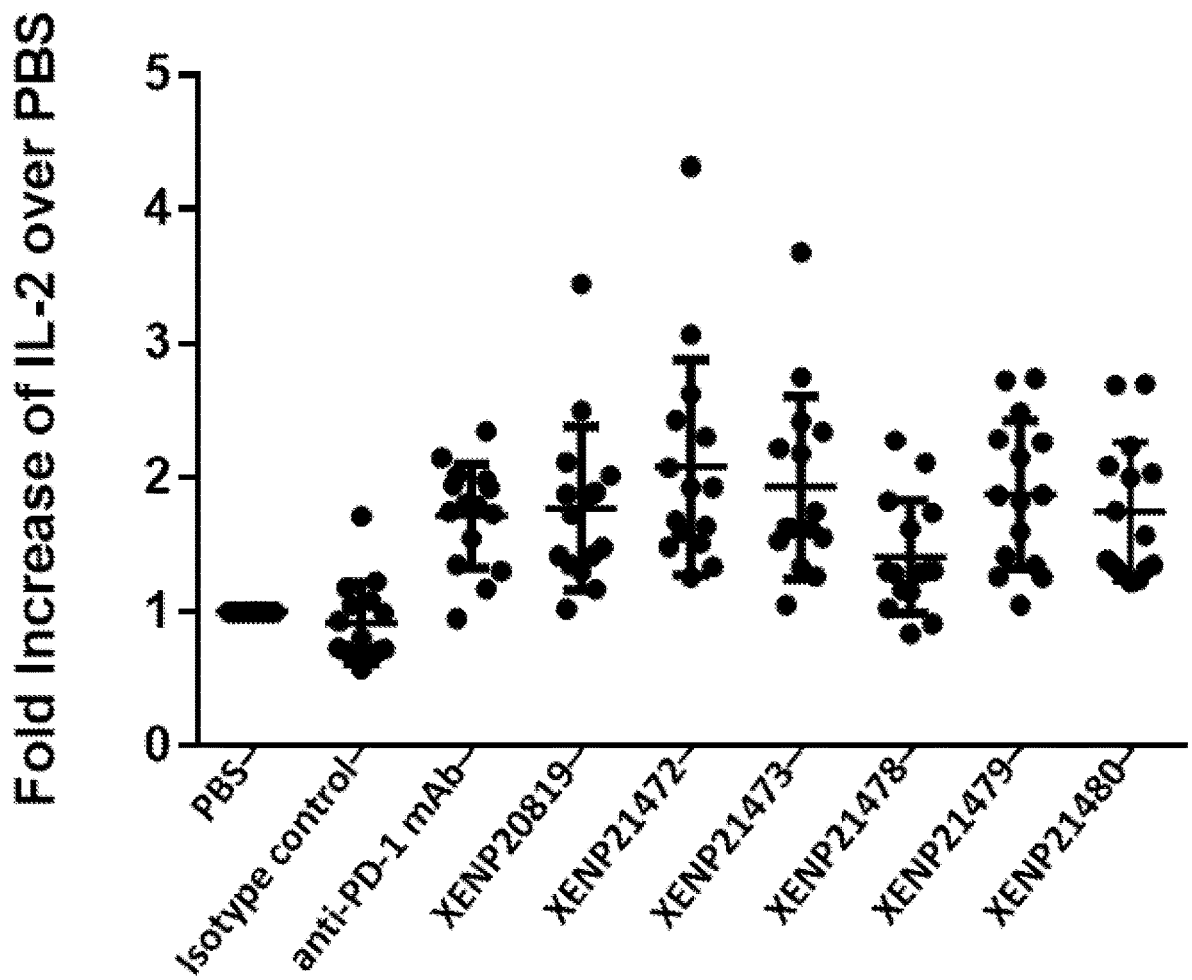

FIG. 80 depicts enhancement of IL-2 secretion by an illustrative PD-1 targeted IL-15/Rα-Fc fusion protein and controls over PBS in an SEB-stimulated PBMC assay.

Figure 81:
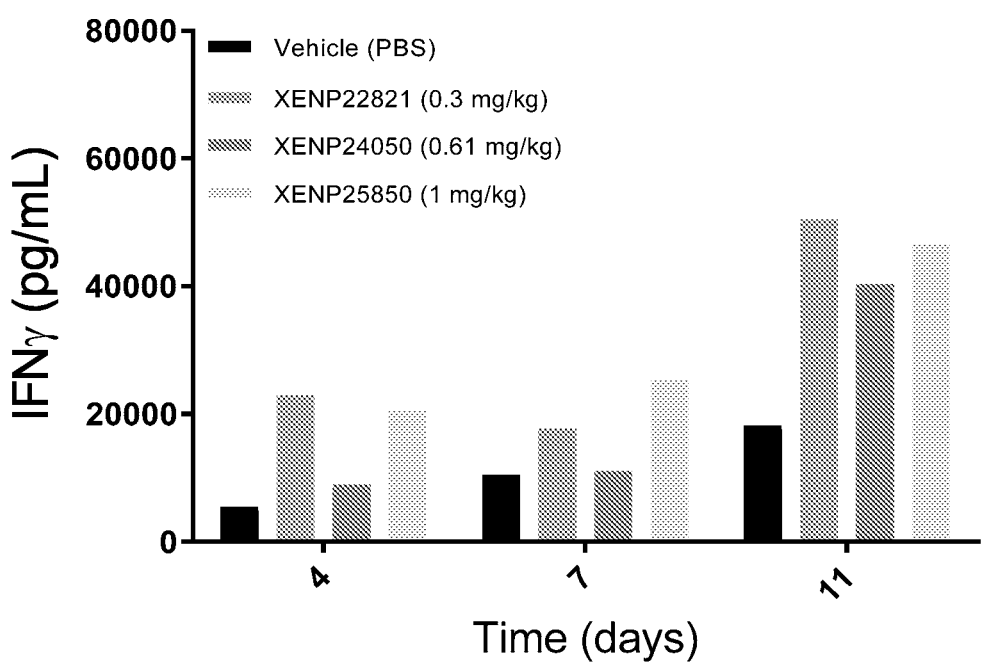

FIG. 81 depicts IFNγ level on Days 4, 7, and 11 in serum of huPBMC engrafted mice following treatment with an illustrative PD-1 targeted IL-15/Rα-Fc fusion protein XENP25850 and controls.

Figure 82A:
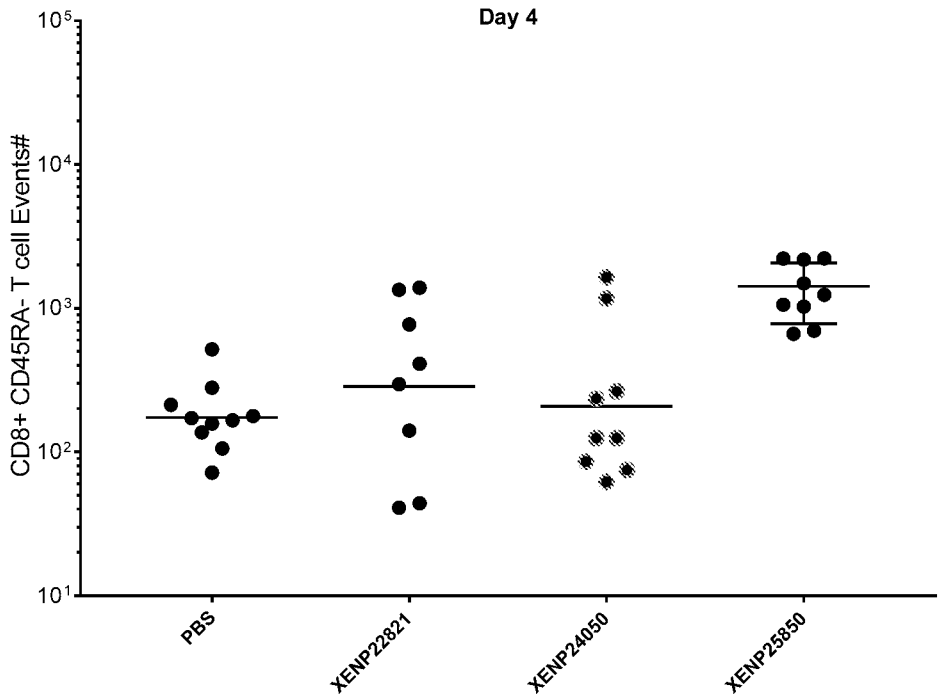
Figure 82B:
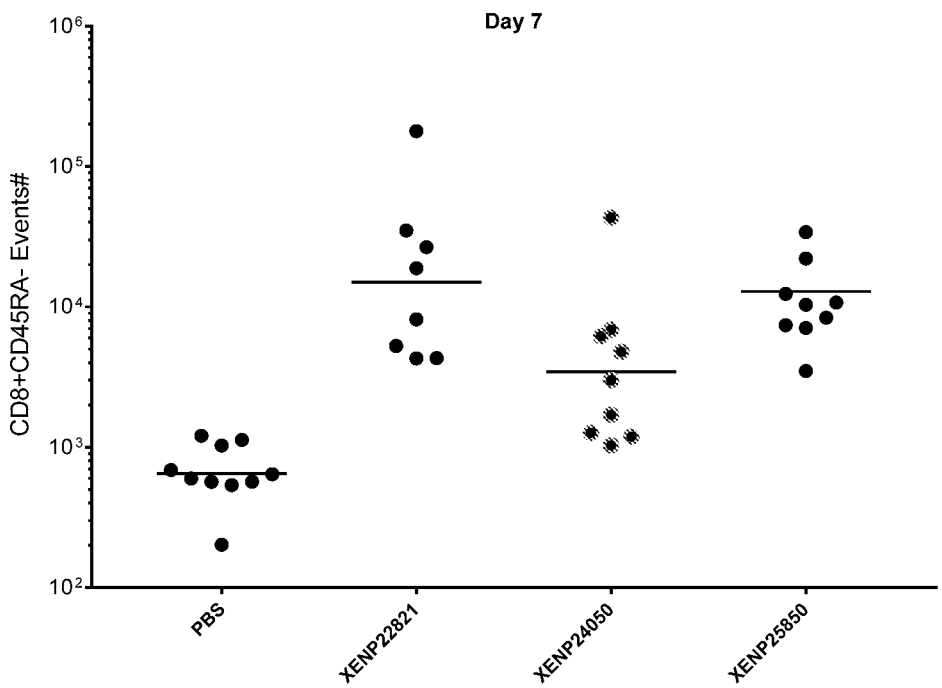
Figure 82C:
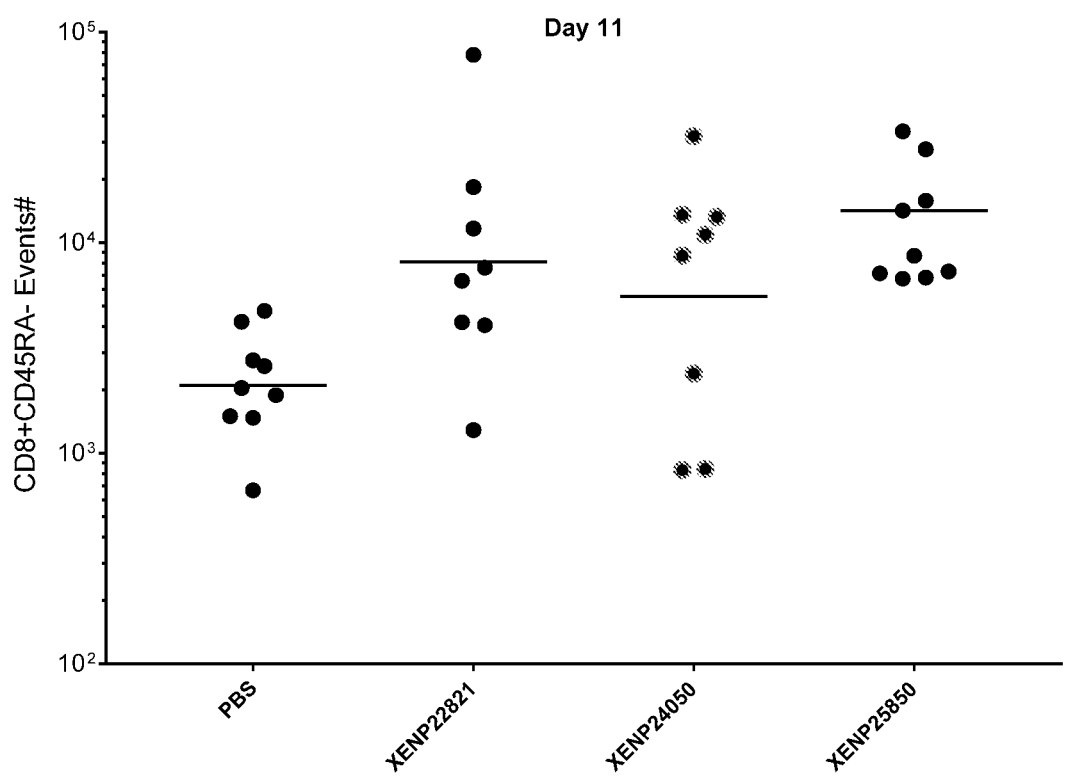

FIGS. 82A-82C depict $CD8^+$ T cell count on Day 4 (FIG. 82A), Day 7 (FIG. 82B), and Day 11 (FIG. 82C) in whole blood of huPBMC engrafted mice following treatment with an illustrative PD-1 targeted IL-15/Rα-Fc fusion protein XENP25850 and controls.

Figure 83A:
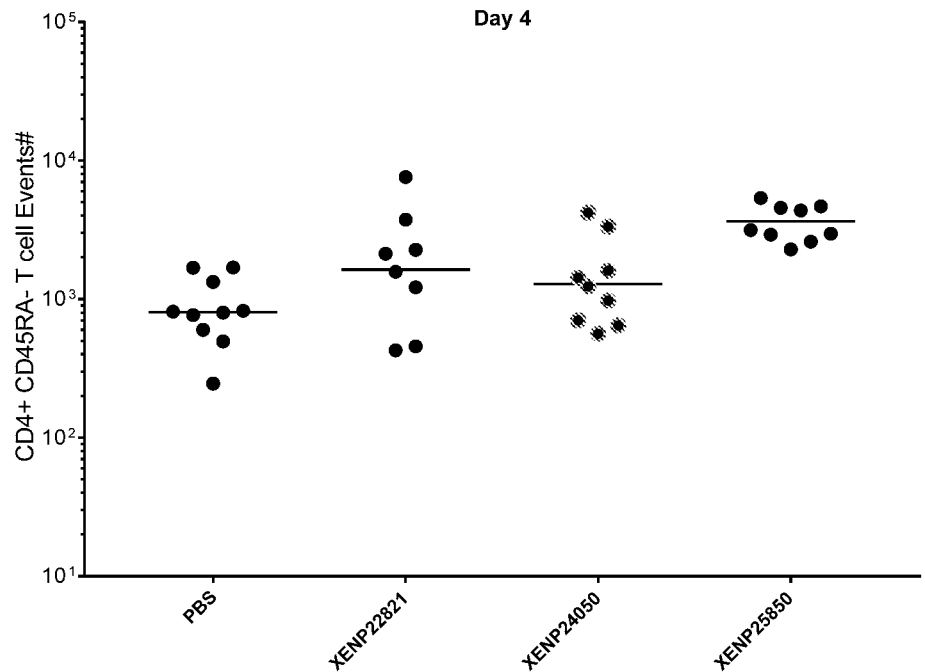
Figure 83B:
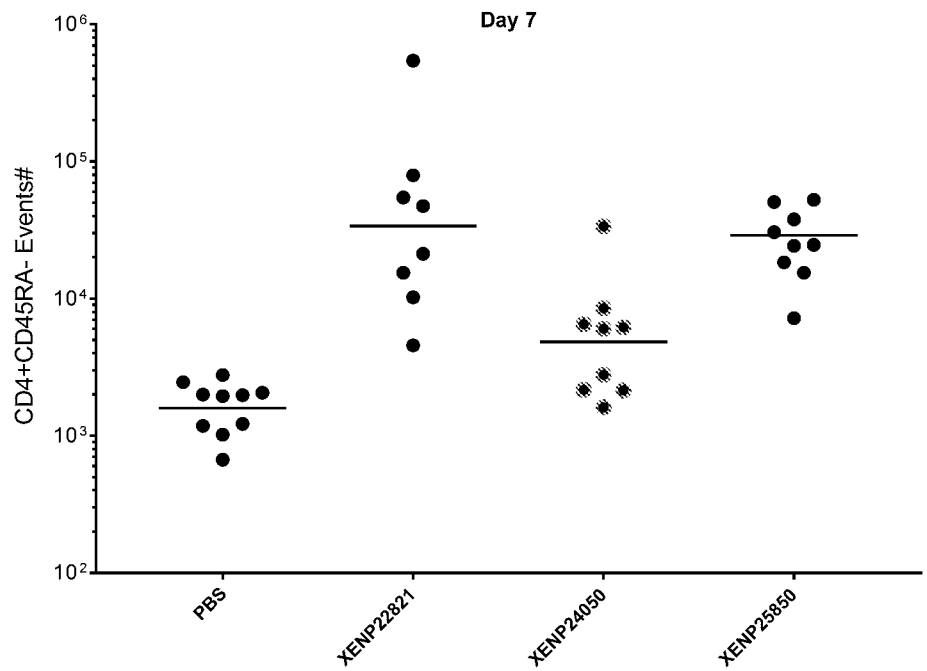

FIGS. 83A-83C depict $CD4^+$ T cell count on Day 4 (FIG. 83A), Day 7 (FIG. 83B), and Day 11 (FIG. 83C) in whole blood of huPBMC engrafted mice following treatment with an illustrative PD-1 targeted IL-15/Rα-Fc fusion protein XENP25850 and controls.

Figure 84A:
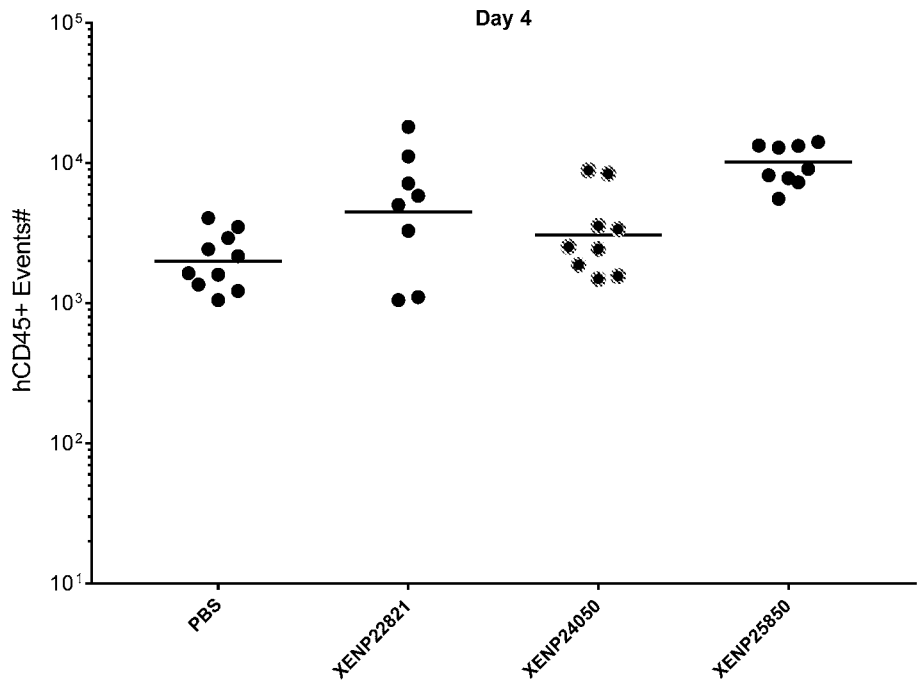
Figure 84B:
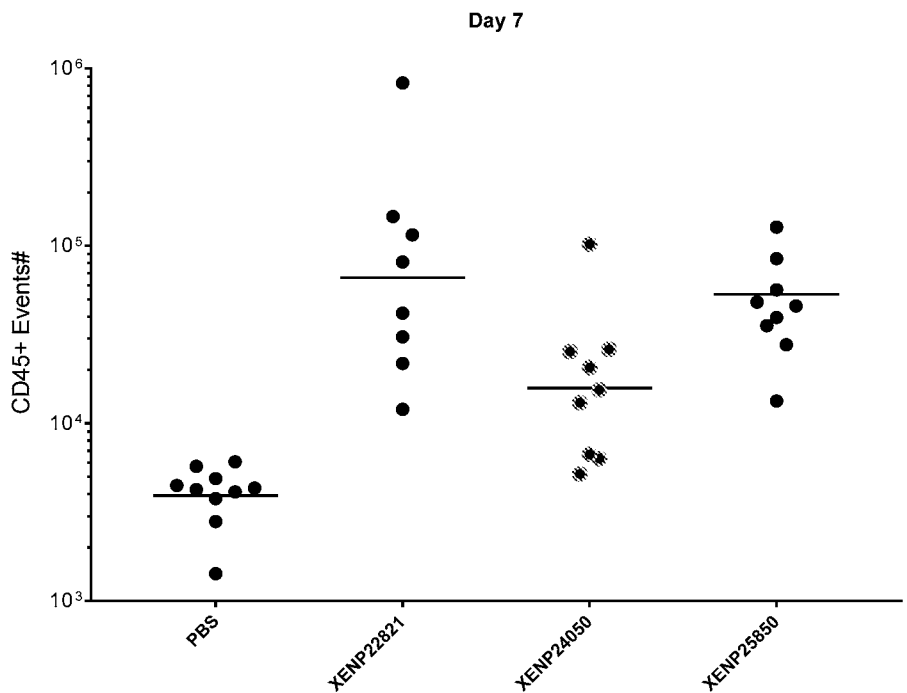
Figure 84C:
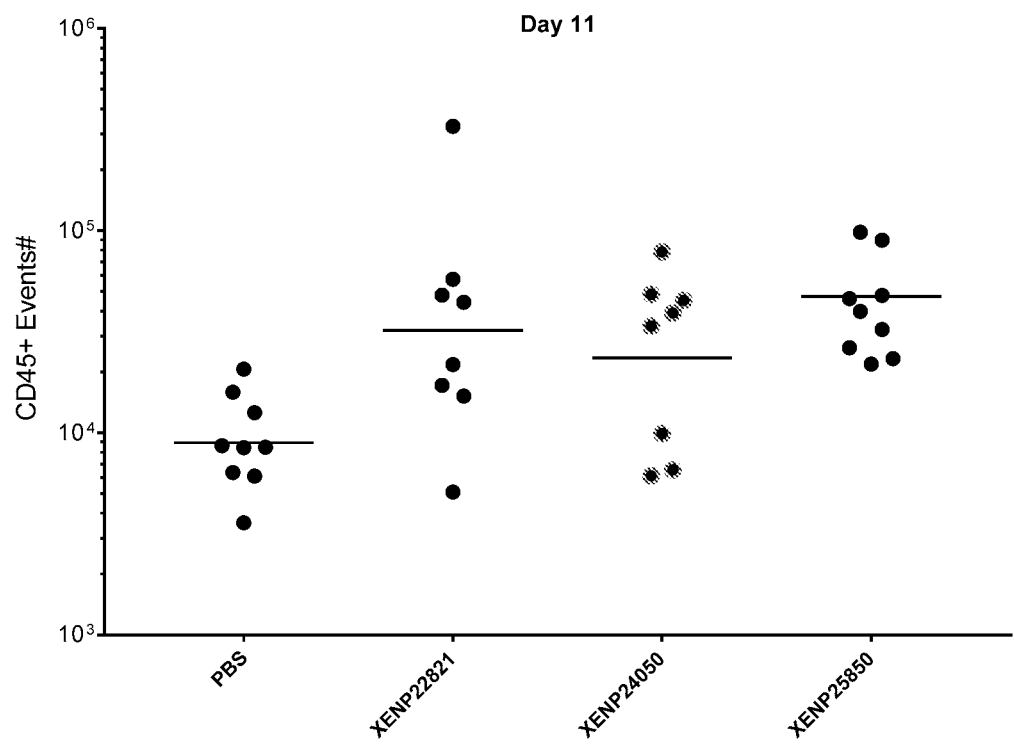

FIGS. 84A-84C depict $CD45^+$ cell count on Day 4 (FIG. 84A), Day 7 (FIG. 84A), and Day 11 (FIG. 84A) in whole blood of huPBMC engrafted mice following treatment with an illustrative PD-1 targeted IL-15/Rα-Fc fusion protein XENP25850 and controls.

Figure 85A:
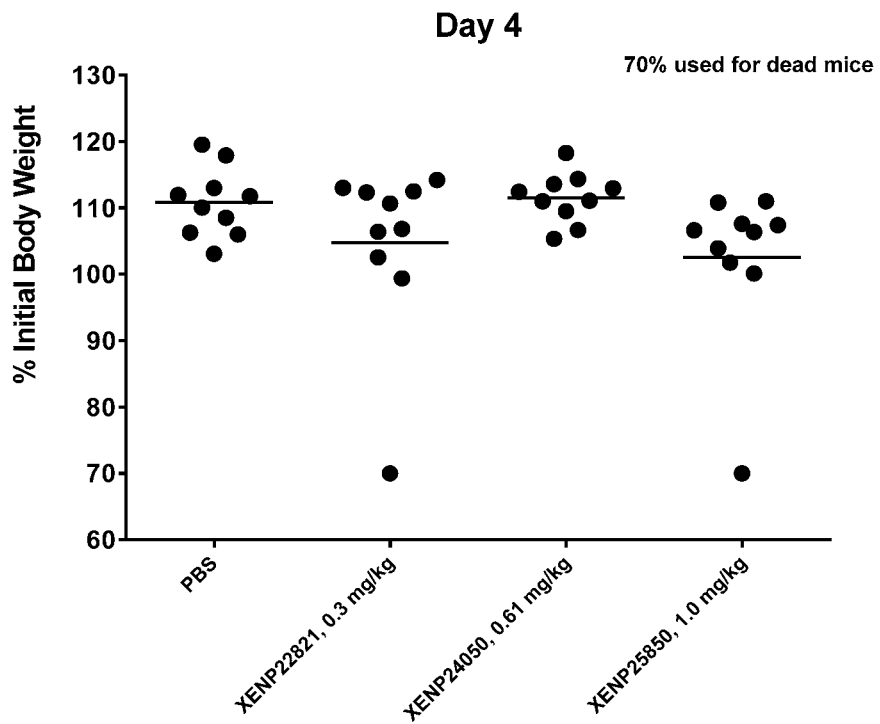
Figure 85B:
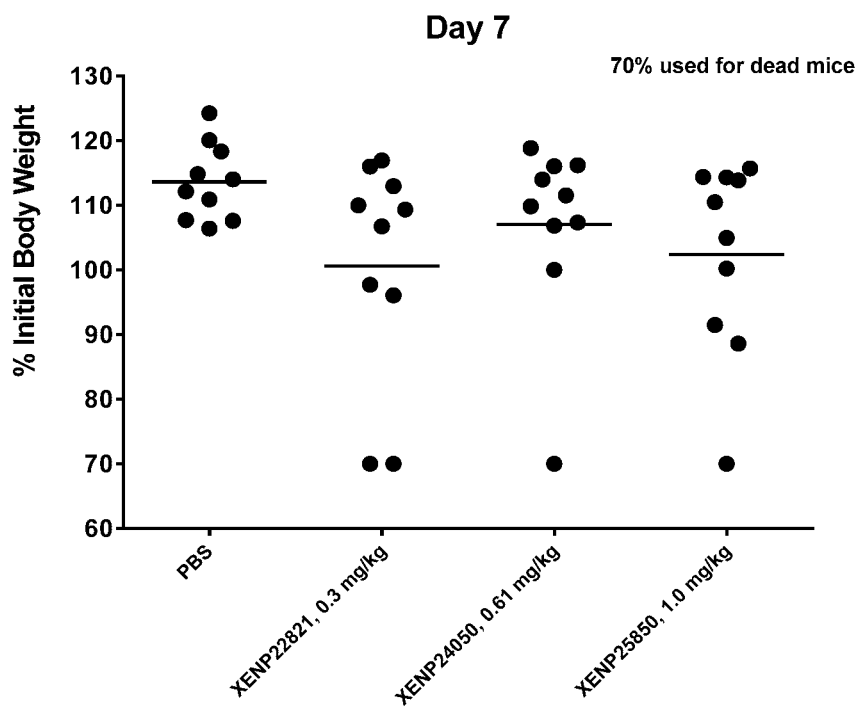
Figure 85C:
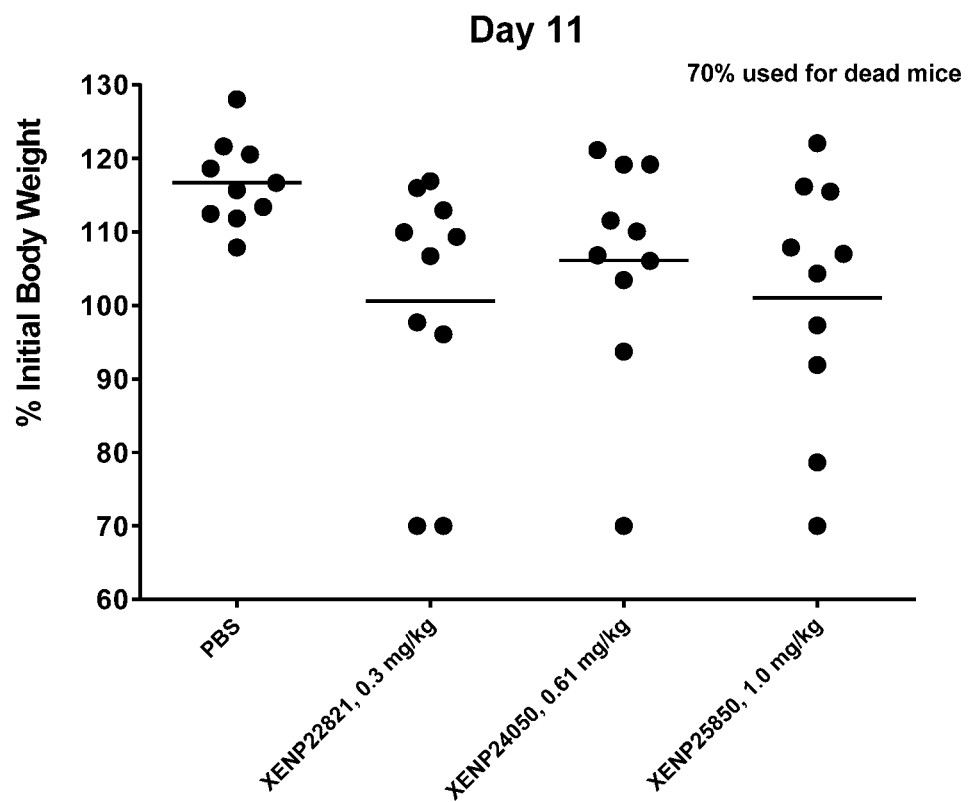

FIGS. 85A-85C depict the body weight as a percentage of initial body weight of huPBMC engrafted mice on Day 4 (FIG. 85A), Day 7 (FIG. 85B), and Day 11 (FIG. 85C) following treatment with an illustrative PD-1 targeted IL-15/Rα-Fc fusion protein XENP25850 and controls. Each point represents a single NSG mouse. Mice whose body weights dropped below 70% initial body weight were euthanized. Dead mice are represented as 70%.

FIG. 86 depicts the sequences for XENP16432, a bivalent anti-PD-1 mAb with an ablation variant (E233P/L234V/L235A/G236del/S267K, "IgG1_PVA_/S267k"). The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems.

FIG. 87 depicts the sequences for an illustrative humanized variant of anti-PD-1 clone 1C11 one-armed antibody (XENP25951) in the human IgG1 format with E233P/L234V/L235A/G236del/S267K substitutions in the heavy chain. The CDRs are in bold, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the IL-15/Rα×anti-PD-1 heterodimeric proteins of the invention.

Figure 88A:
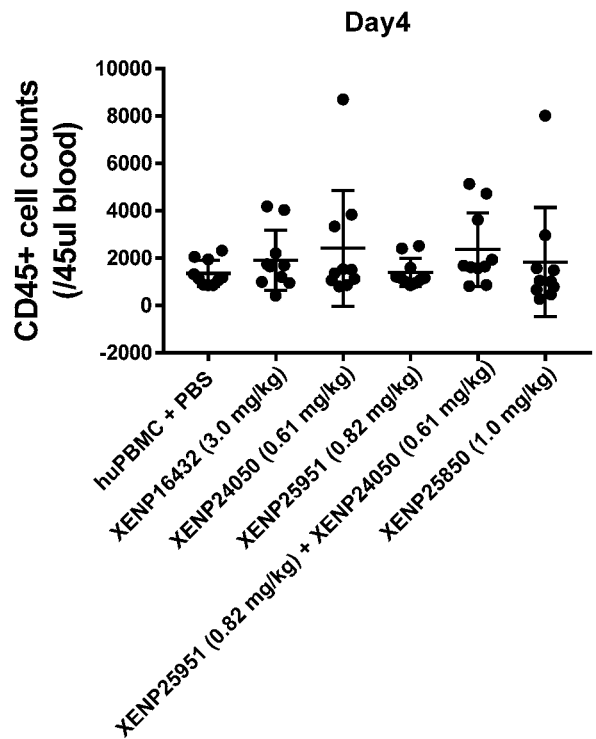
Figure 88B:
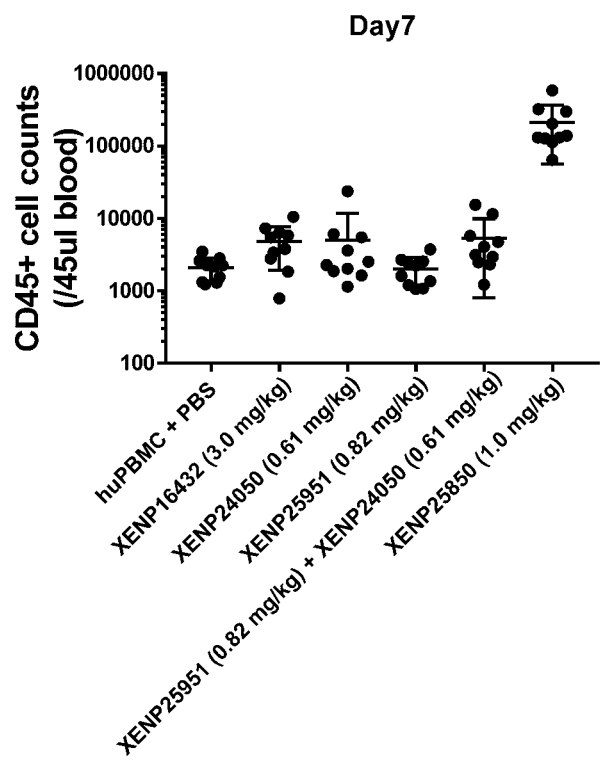
Figure 88C:
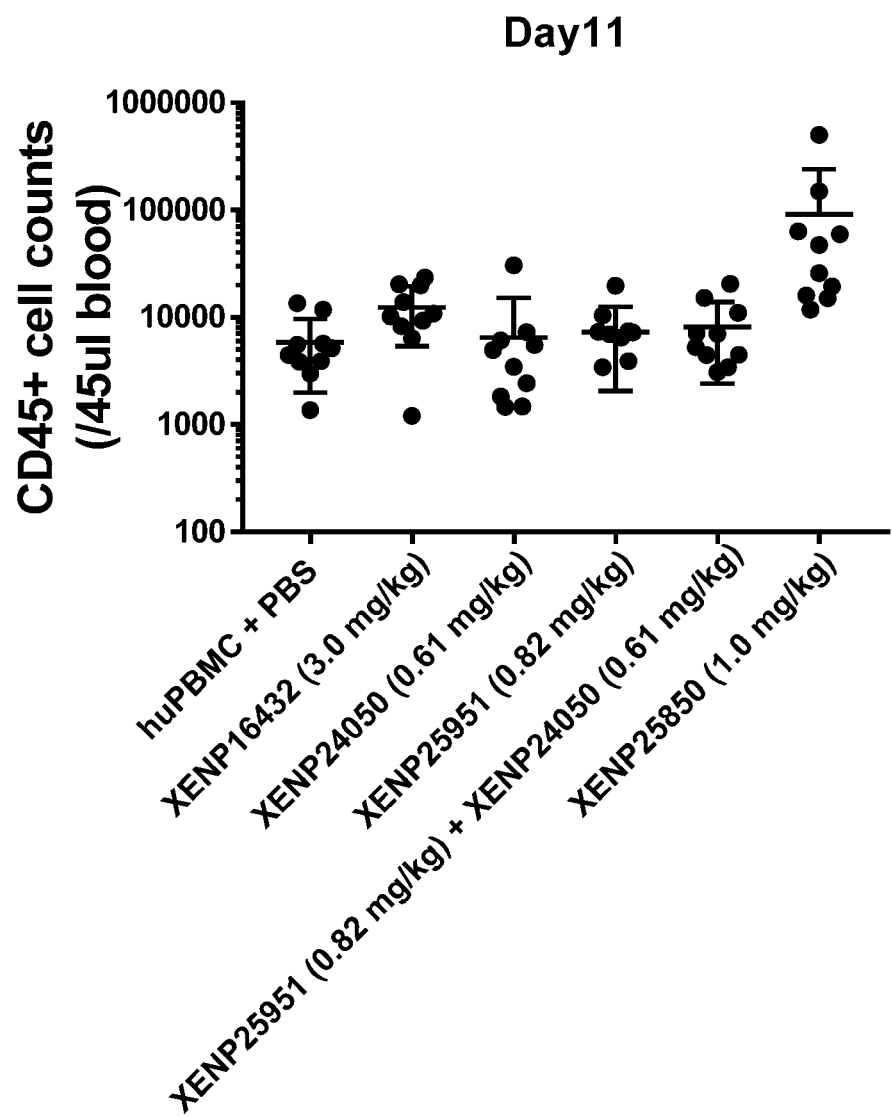

FIGS. 88A-88C depict the $CD45^+$ cell count in NSG mice on Day 4 (FIG. 88A), Day 7 (FIG. 88B), and Day 11 (FIG. 88C) following treatment with the indicated test articles.

Figure 89A:
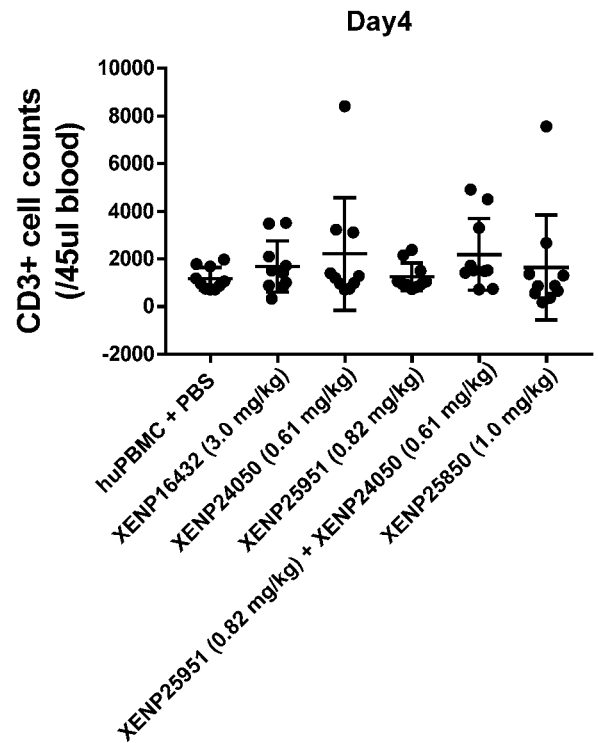
Figure 89B:
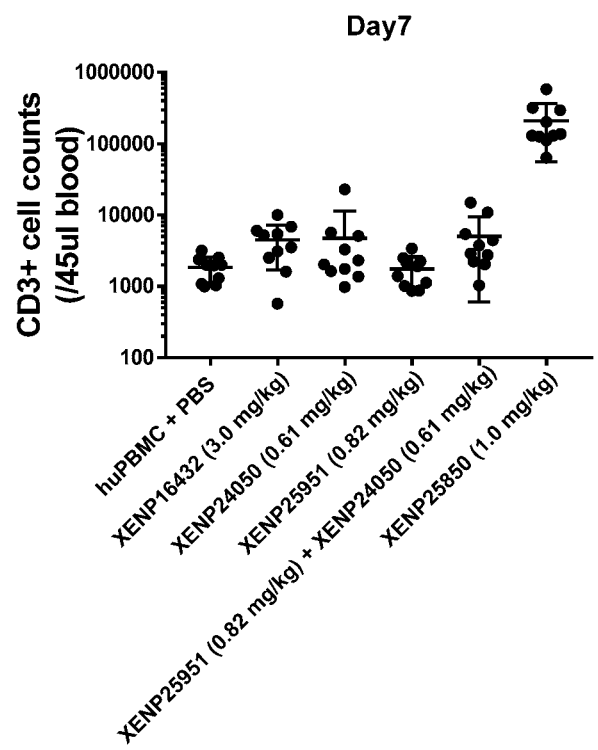
Figure 89C:
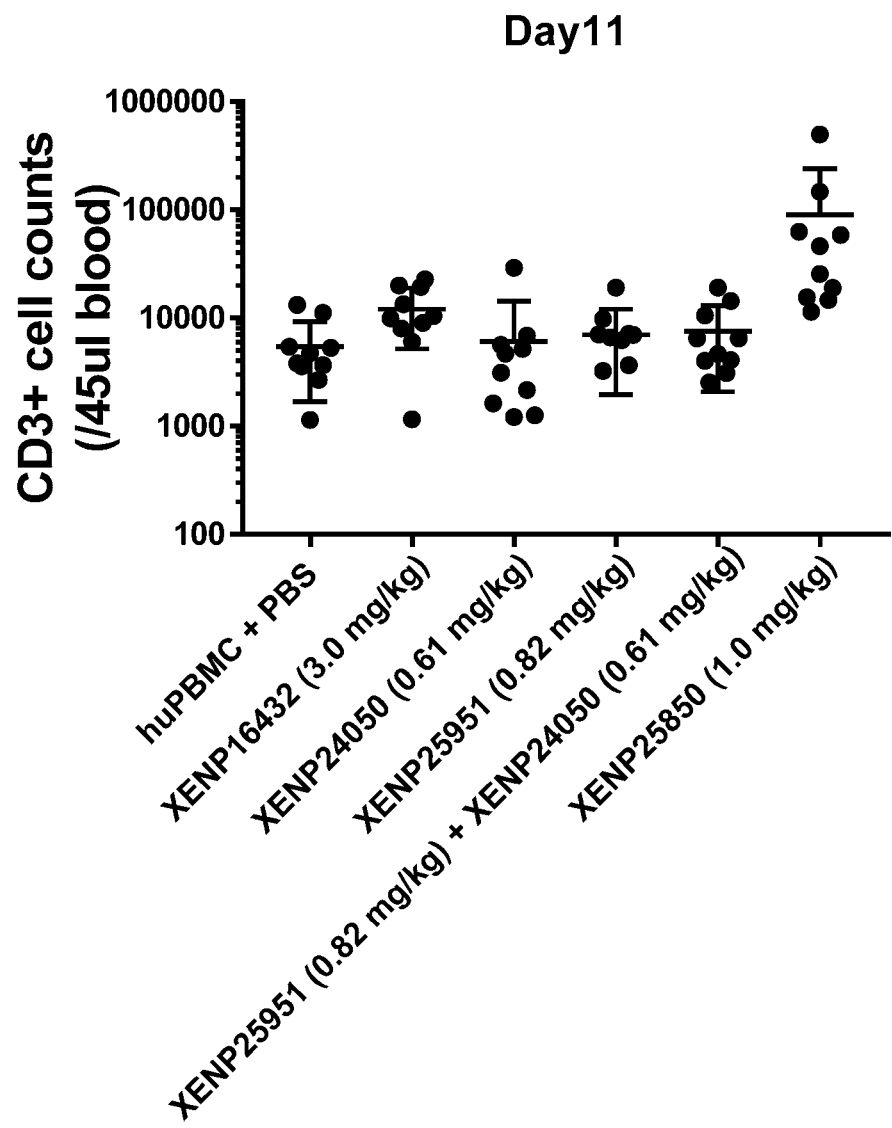

FIGS. 89A-89C depict the $CD3^+$ cell count in NSG mice on Day 4 (FIG. 89A), Day 7 (FIG. 89B), and Day 11 (FIG. 89C) following treatment with the indicated test articles.

Figure 90A:
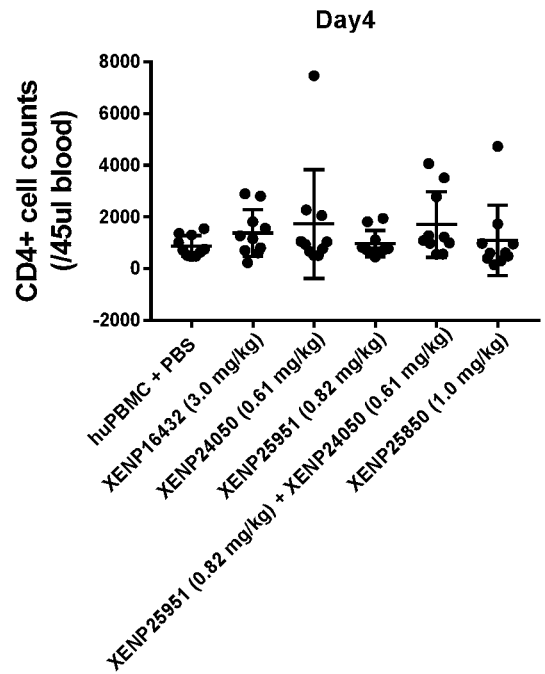
Figure 90B:
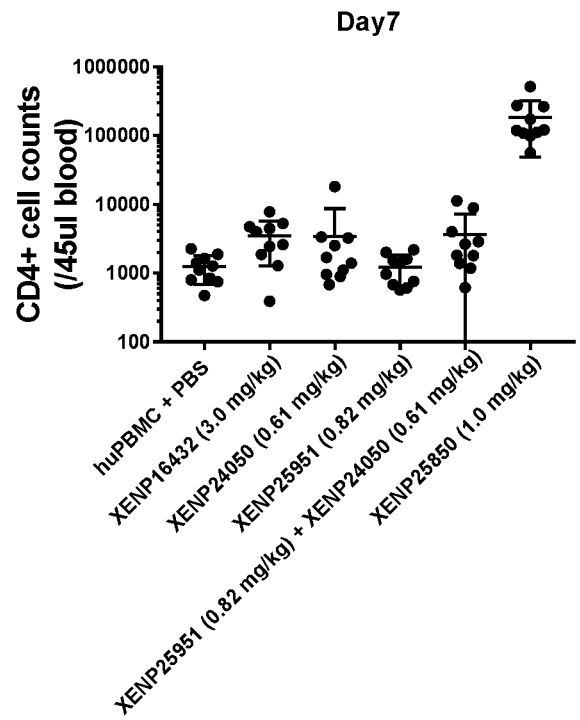
Figure 90C:
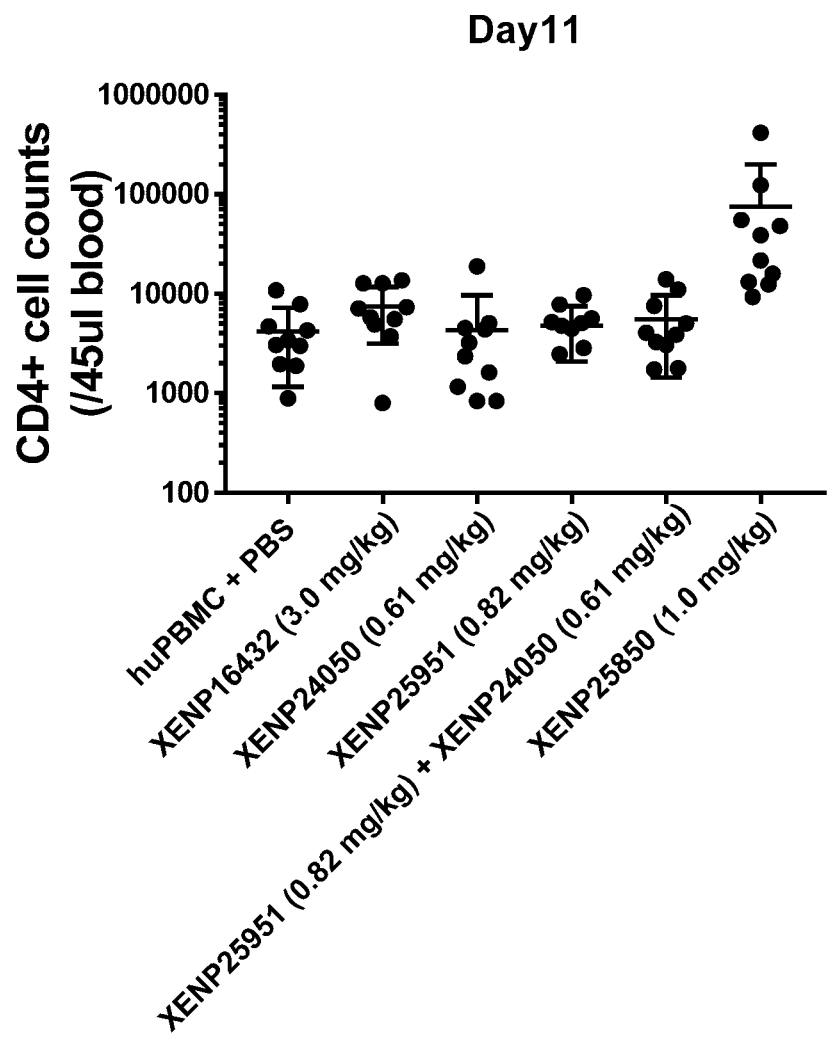

FIGS. 90A-90C depict the $CD4^+$ cell count in NSG mice on Day 4 (FIG. 90A), Day 7 (FIG. 90B), and Day 11 (FIG. 90C) following treatment with XENP24050 (0.61 mg/kg), XENP25951 (0.82 mg/kg), XENP25951 (0.82 mg/kg)+XENP24050 (0.61 mg/kg), or XENP25850 (1.0 mg/kg).

Figure 91A:
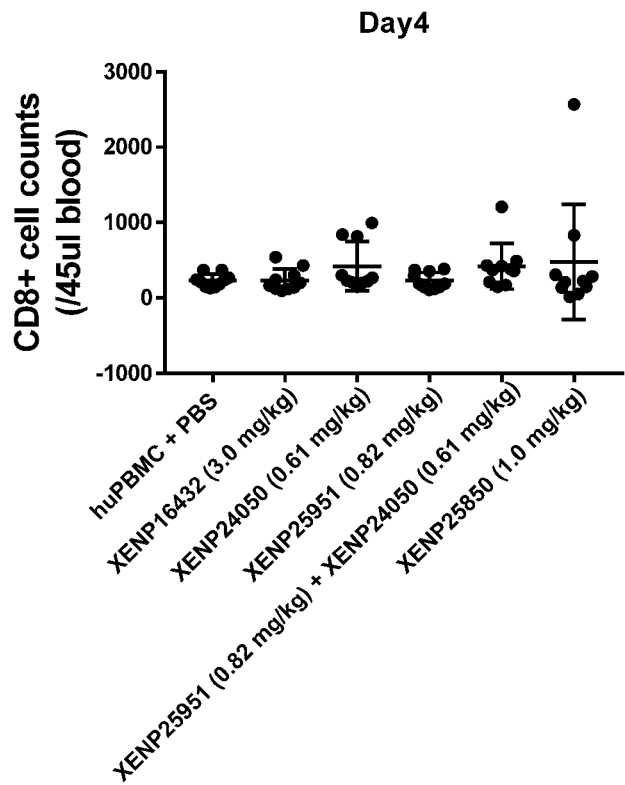
Figure 91B:
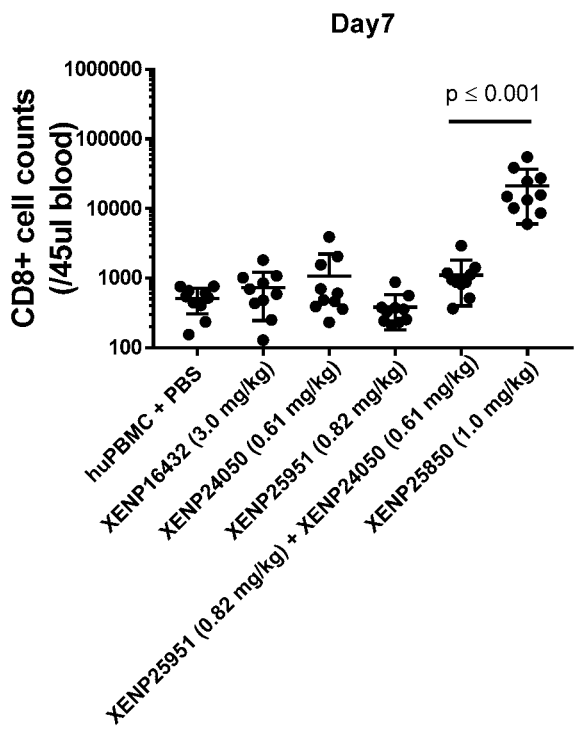
Figure 91C:
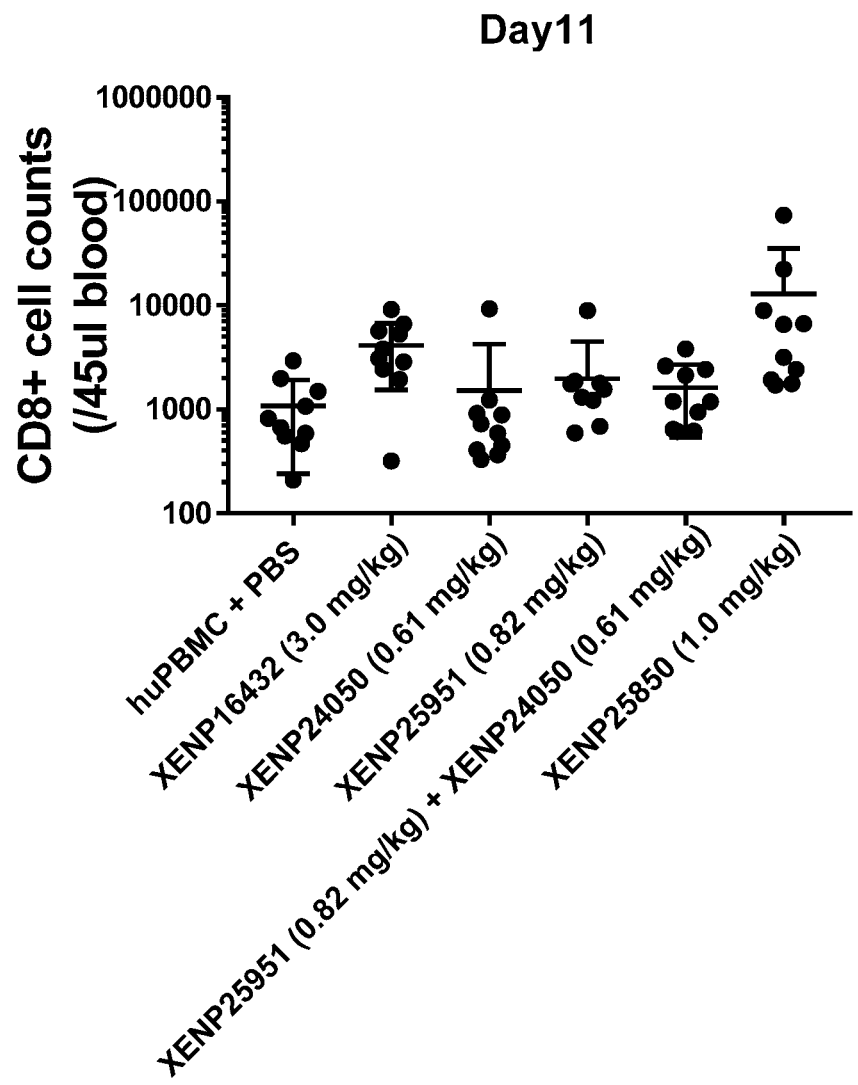
Figure 92A:
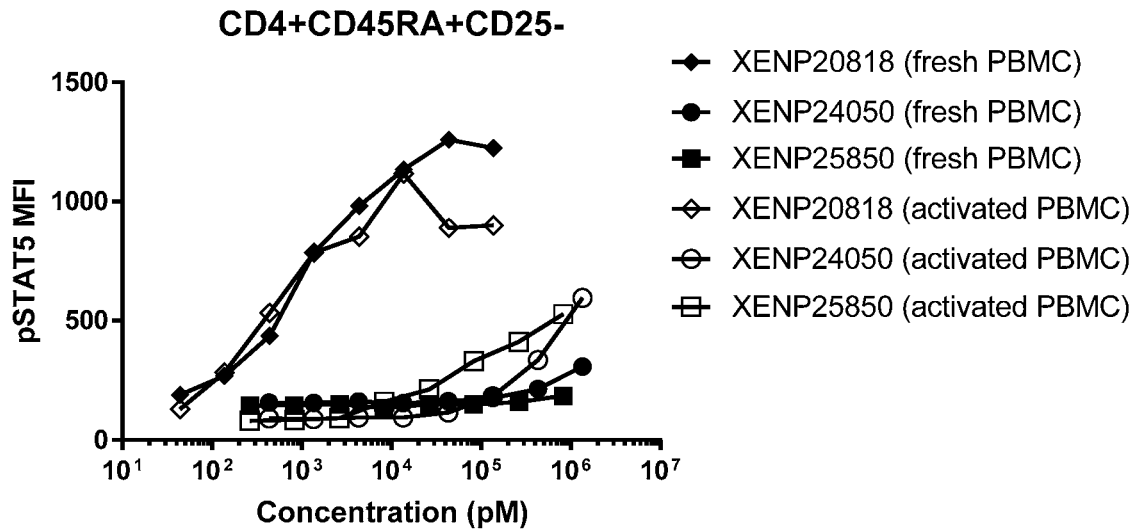
Figure 92B:
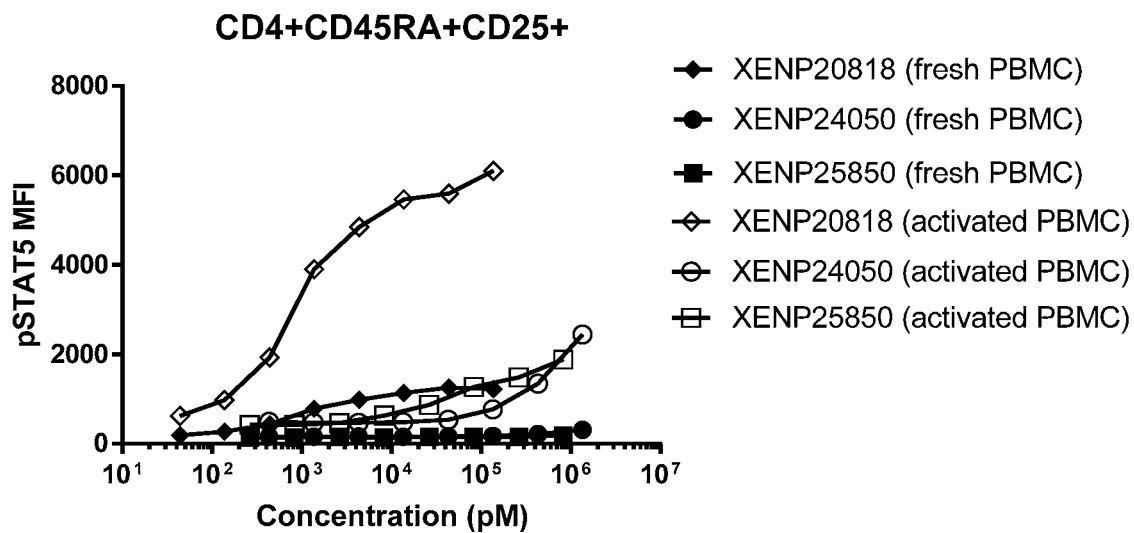
Figure 92C:
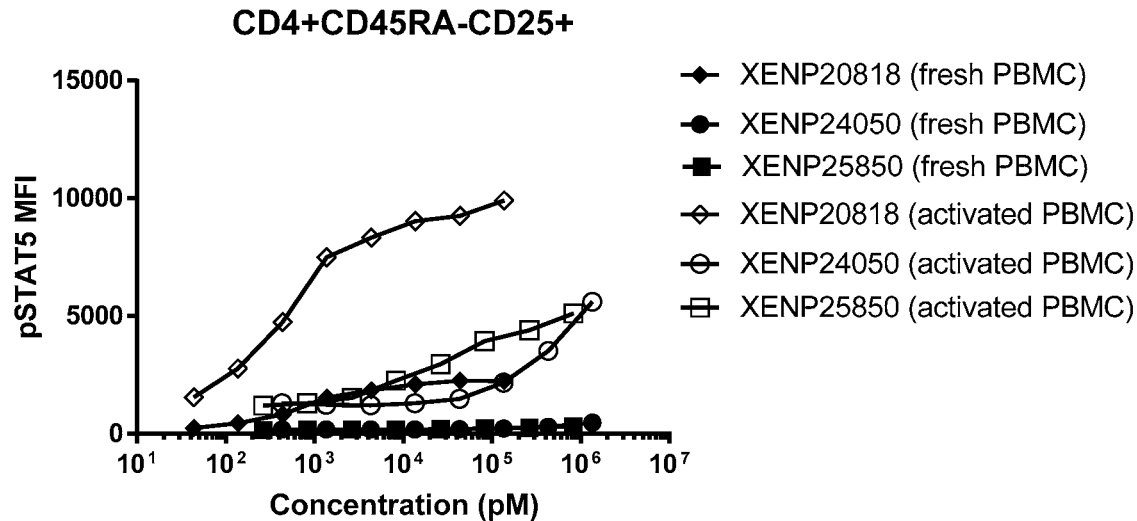
Figure 92D:
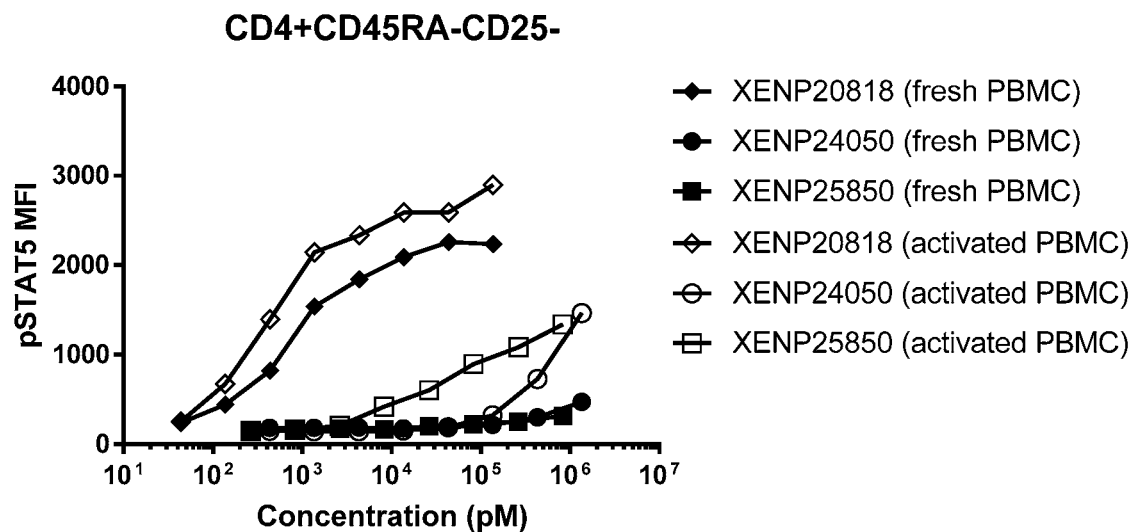
Figure 92E:
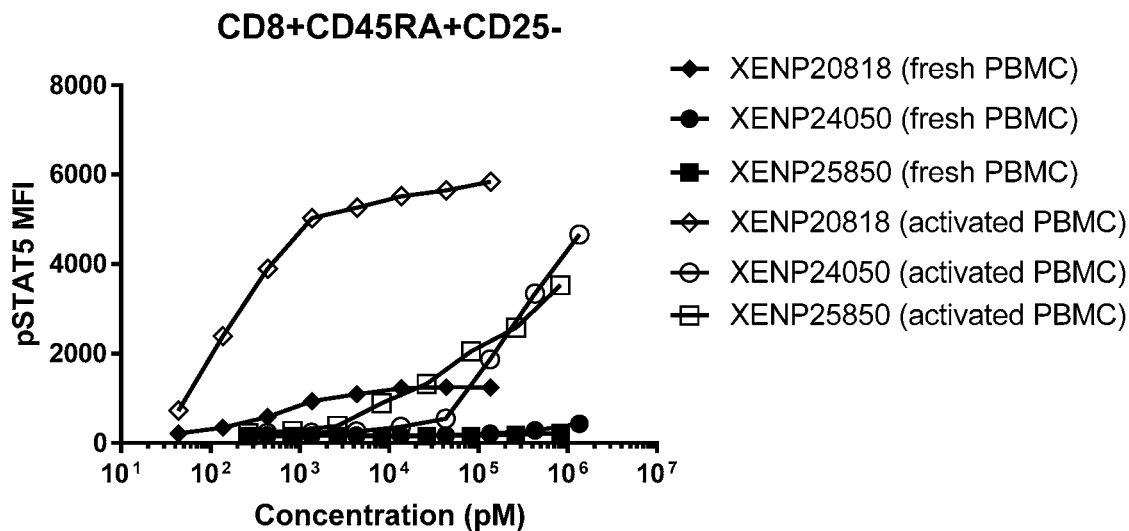
Figure 92F:
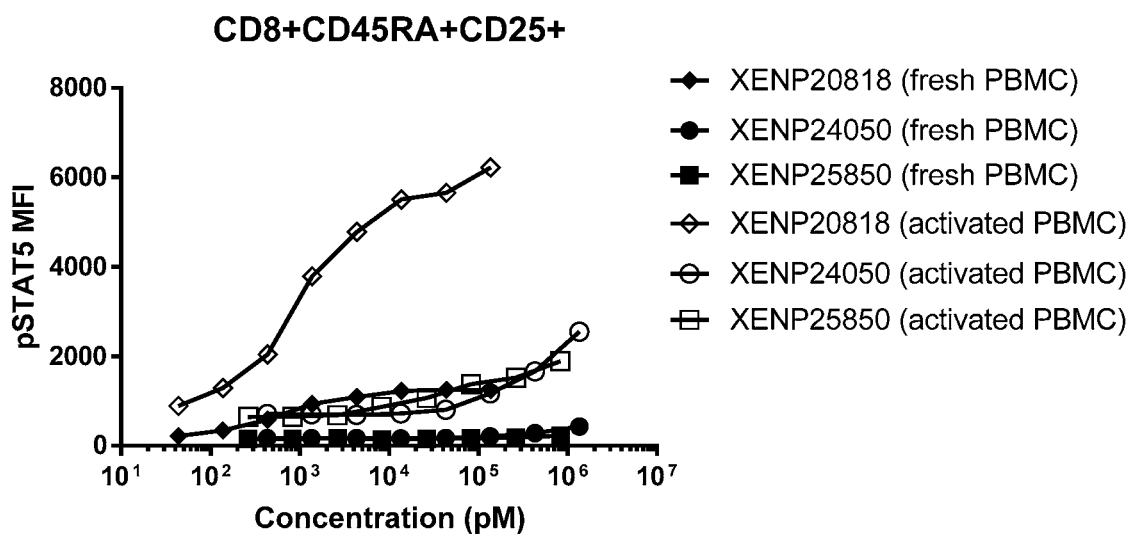
Figure 92G:
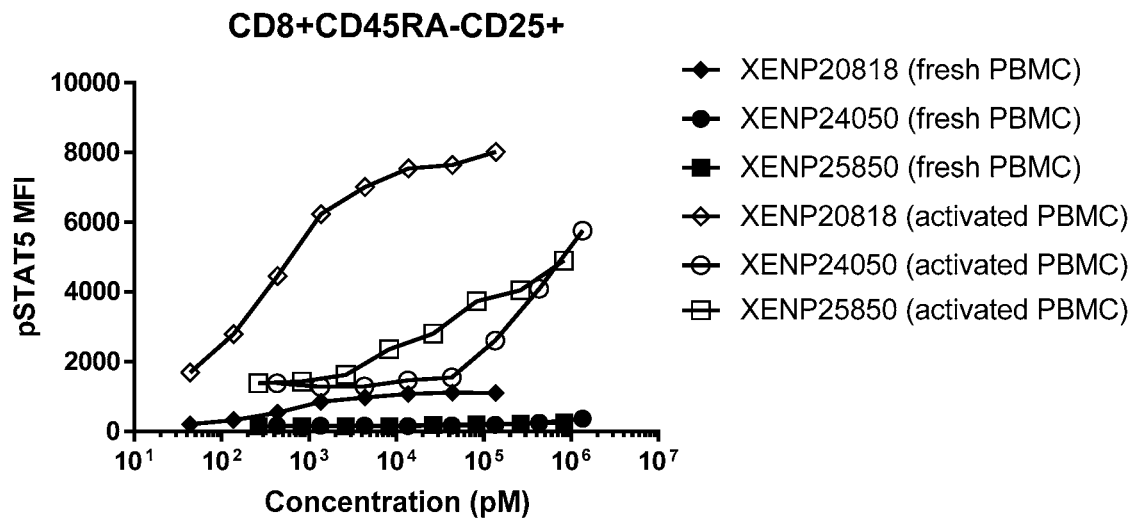
Figure 92H:
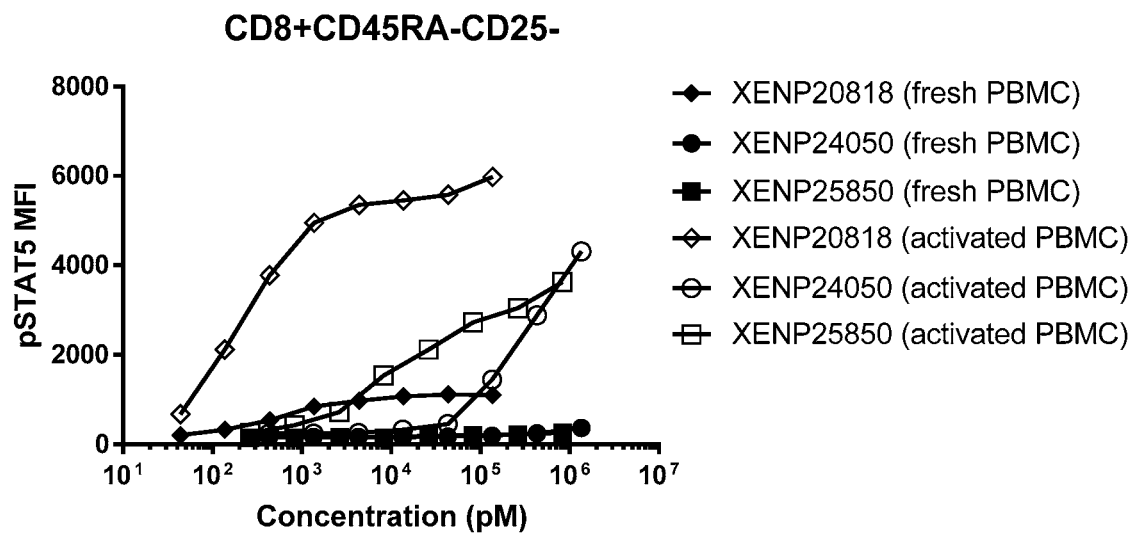

FIGS. 91A-91C depict the $CD8^+$ cell count in NSG mice on Day 4 (FIG. 91A), Day 7 (FIG. 91B), and Day 11 (FIG. 91C) following treatment with the indicated test articles.

FIGS. 92A-92H depict induction of STAT5 phosphorylation on $CD4^+CD45RA^+CD25^-$ (FIG. 92A), $CD4^+CD45RA^+CD25^+$ (FIG. 92B), $CD4^+CD45RA^- CD25^+$ (FIG. 92C), $CD4^+CD45RA^-CD25^-$ (FIG. 92D), $CD8^+CD45RA+CD25^-$ (FIG. 92E), $CD8^+CD45RA+CD25^+$ (FIG. 92F), $CD8^+CD45RA^-CD25^+$ (FIG. 92G), and $CD8^+CD45RA^-CD25^-$ (FIG. 92H) by XENP20818 (WT IL-15/Rα-Fc), XENP24050 (an illustrative reduced potency IL-15/Rα-Fc), and XENP25850 (an illustrative PD-1-targeted IL-15/Rα-Fc fusion). Fresh cells are indicated in dotted lines, and activated cells are indicated in solid lines. Fresh cells are all $CD25^-$.

FIGS. 93A-93S depict sequences for illustrative scFv variants of anti-PD-1 clone 1C11. The scFv variant name is in bold and the CDRs are underlined, the scFv linker is double underlined (in the sequences, the scFv linker is a positively charged scFv (GKPGS)$_4$ linker, although as will be appreciated by those in the art, this linker can be replaced by other linkers, including uncharged or negatively charged linkers, such as but not limit to those in FIG. 9 and FIG. 10), and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. Further, the naming convention illustrates the orientation of the scFv from N- to C-terminus; some of the sequences in this Figure are oriented as $V_H$-scFv linker-$V_L$ (from N- to C-terminus), while some are oriented as $V_L$-scFv linker-$V_H$ (from N- to C-terminus), although as will be appreciated by those in the art, these sequences may also be used in the opposition orientation from their depiction herein. Furthermore, as will be appreciated by those in the art, the $V_H$ and $V_L$ domains can be formatted as Fabs or scFvs. Additionally, each CDR has its own SEQ ID NO: or sequence identifier in the sequence listing, and each VH and VL domain has its own SEQ ID NO: or sequence identifier in the sequence listing.

FIGS. 94A-94AO depict sequences for illustrative variant anti-PD-1 mAbs based on clone 1C11. The variant anti-PD-1 mAb name is in bold and the CDRs are underlined, and the slashes indicate the borders of the variable domains. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fabs or scFvs. Additionally, each CDR has its own SEQ ID NO or sequence identifier in the sequence listing, and each VH and VL domain has its own SEQ ID NO or sequence identifier in the sequence listing.

FIGS. 95A-95J depict sequences for variant heavy chains based on the heavy chain of XENP22553. The variable heavy chain name is in bold and the CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_H$ domain. As will be appreciated by those in the art, the $V_H$ domains can be used in Fabs or scFvs. Additionally, each CDR has its own SEQ ID NO or sequence identifier in the sequence listing, and each VH domain has its own SEQ ID NO or sequence identifier in the sequence listing.

FIGS. 96A-96F depict sequences for variant light chains based on the light chain of XENP22553. The variable light chain name is in bold and the CDRs are underlined. As noted herein and is true for every sequence herein containing CDRs, the exact identification of the CDR locations may be slightly different depending on numbering used as is shown in Table 1, and thus included herein are not only the CDRs that are underlined but also CDRs included within the $V_L$ domains using other numbering systems. As will be appreciated by those in the art, the $V_L$ domains can be used in Fabs or scFvs. Additionally, each CDR has its own SEQ ID NO or sequence identifier in the sequence listing, and each VL domain has its own SEQ ID NO or sequence identifier in the sequence listing.

FIGS. 97A-97O depict the stability of variant anti-PD-1 scFvs as determined by DSF and equilibrium dissociation constants ($K_D$), association rates ($k_a$), and dissociation rates ($k_d$) of anti-PD-1 mAbs based on the VH/VL from the variant scFvs as determined by Octet. XENP for scFvs are in bold, and XENP for full-length mAb are in parentheses.

FIG. 98 depicts the of equilibrium dissociation constants ($K_D$), association rates ($k_a$), and dissociation rates ($k_d$) of variant anti-PD-1 mAbs as determined by Octet.

FIG. 99 depicts the of equilibrium dissociation constants ($K_D$), association rates ($k_a$), and dissociation rates ($k_d$) of variant anti-PD-1 mAbs as determined by Octet.

FIG. 100 depicts the affinity/dissociation constants ($K_D$), association rates ($k_a$), and dissociation rates ($k_d$) of anti-PD-11C11 variants for human PD-1 as determined by Octet.

FIG. 101 depicts the affinity/dissociation constants ($K_D$), association rates ($k_a$), and dissociation rates ($k_d$) of anti-PD-11C11 variants for human PD-1 as determined by Octet.

FIG. 102 depicts the affinity/dissociation constants ($K_D$), association rates ($k_a$), and dissociation rates ($k_d$) of anti-PD-11C11 variants for human PD-1 as determined by Octet.

FIG. 103 depicts the affinity/dissociation constants ($K_D$), association rates ($k_a$), and dissociation rates ($k_d$) of anti-PD-11C11 variants for human PD-1 as determined by Octet.

FIG. 104 depicts the affinity/dissociation constants ($K_D$), association rates ($k_a$), and dissociation rates ($k_d$) of anti-PD-11C11 variants for human PD-1 and cynomolgus PD-1 as determined by Octet.

FIGS. 105A-105E depict the of equilibrium dissociation constants ($K_D$), association rates ($k_a$), and dissociation rates ($k_d$) of variant anti-PD-1 mAbs as determined by Octet. Variants are defined by heavy chain and light chain XenDs as depicted in FIG. 95A-FIG. 95J and FIG. 96A-FIG. 96F.

FIG. 106 depicts the of equilibrium dissociation constants ($K_D$), association rates ($k_a$), and dissociation rates ($k_d$) of variant anti-PD-1 mAbs as determined by Octet. Variants are defined by heavy chain and light chain XenDs as depicted in FIG. 95A-FIG. 95J and FIG. 96A-FIG. 96F.

FIG. 107 depicts the affinity ($K_D$) of anti-PD-11C11 variants as determined by Biacore.

Figure 108:
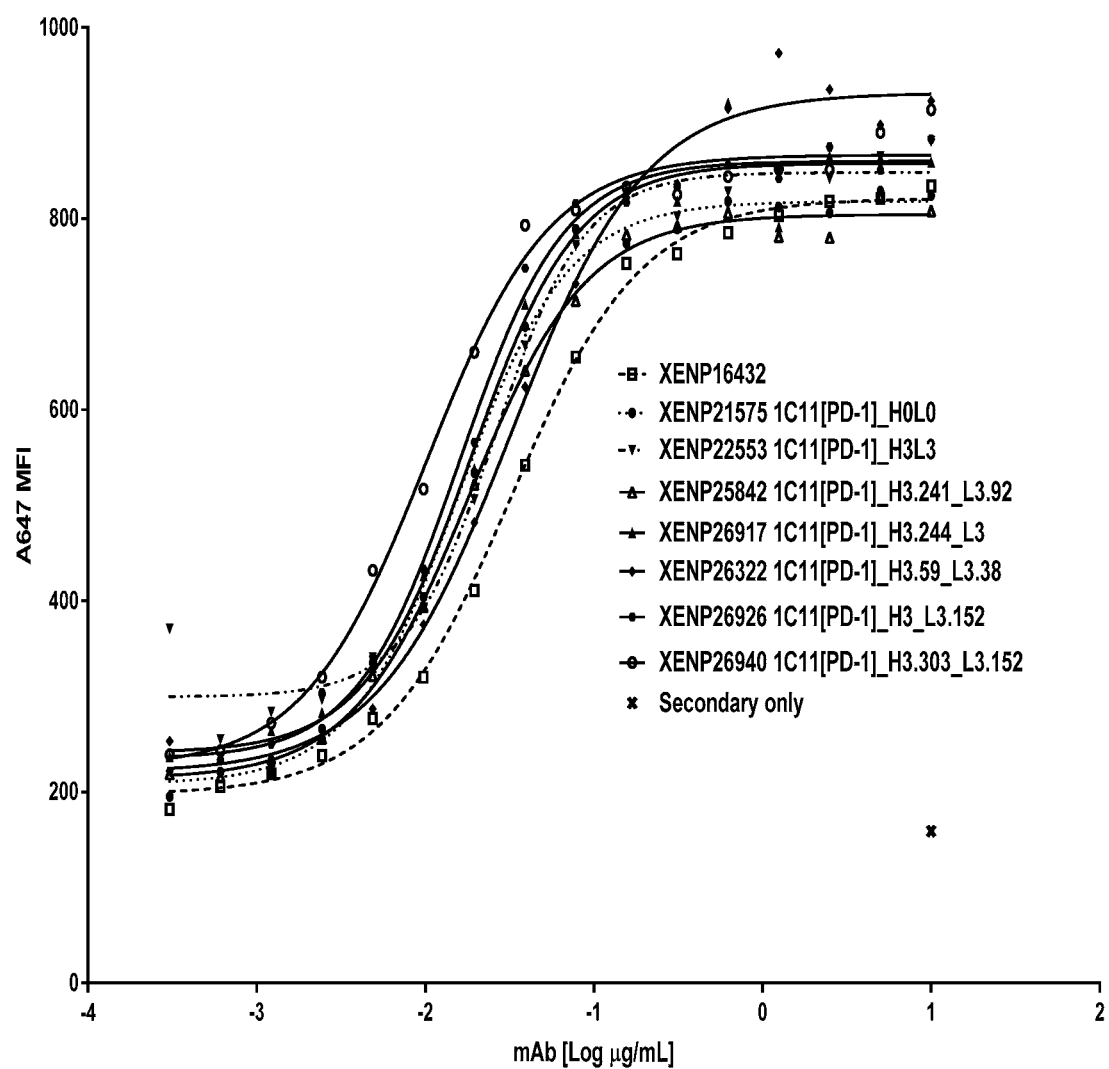

FIG. 108 depicts the binding of affinity optimized anti-PD-11C11 variants to SEB-stimulated T cells.

FIGS. 109A-109D depict sequences of illustrative PD-1-targeted IL-15/Rα-Fc fusions comprising affinity-optimized PD-1-targeting arms. The CDRs are in bold. As noted herein and is true for every sequence herein containing CDRs, the exact identification of the CDR locations may be slightly different depending on the numbering used as is shown in Table 1 and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10 and slashes (/) indicate the border(s) between IL-15, IL-15Rα, linkers, variable regions, and constant/Fc regions.

Figure 110A:
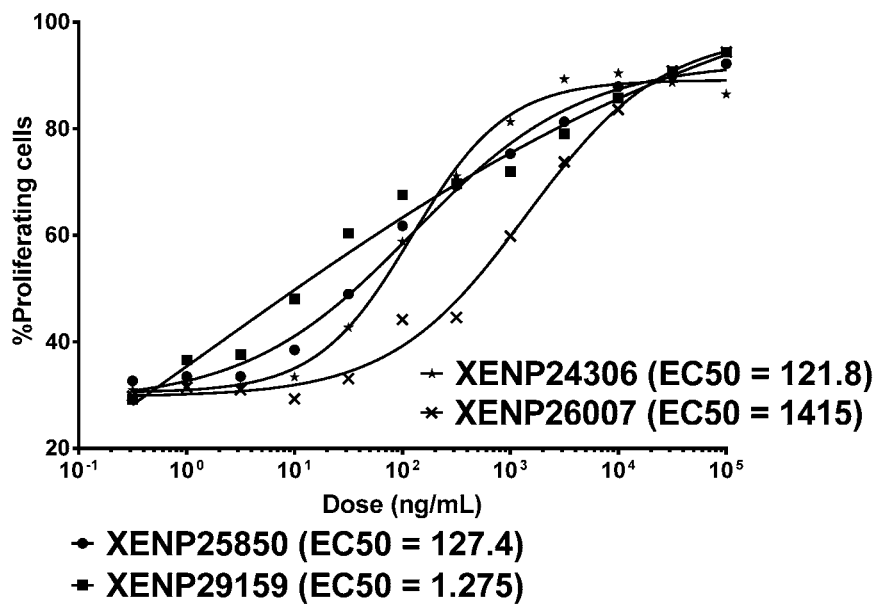
Figure 110B:
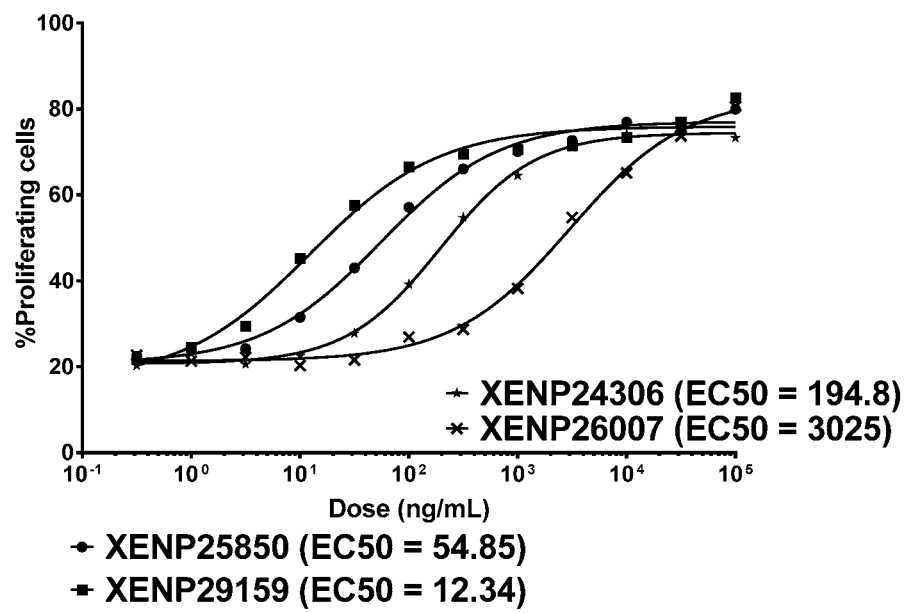

FIGS. 110A-110B depict induction of A) CD8$^+$ T cells and B) CD4$^+$ T cells proliferation by PD-1-targeted IL-15/Rα-Fc fusions (and controls) as indicated by percentage proliferating cells (determined based on CFSE dilution). The data show that PD-1-targeted IL-15/Rα-Fc fusions are more potent in inducing proliferation of CD4$^+$ T cells in comparison to untargeted IL-15(D30N/E64Q/N65D)/Rα-Fc fusion (as well as control RSV-targeted IL-15/Rα-Fc fusion). Notably, XENP29159 which has a higher-affinity PD-1 binding domain was more potent than XENP25850 (as well as XENP24306 and XENP26007) in proliferation of both CD8+ and CD4+ T cells.

Figure 111A:
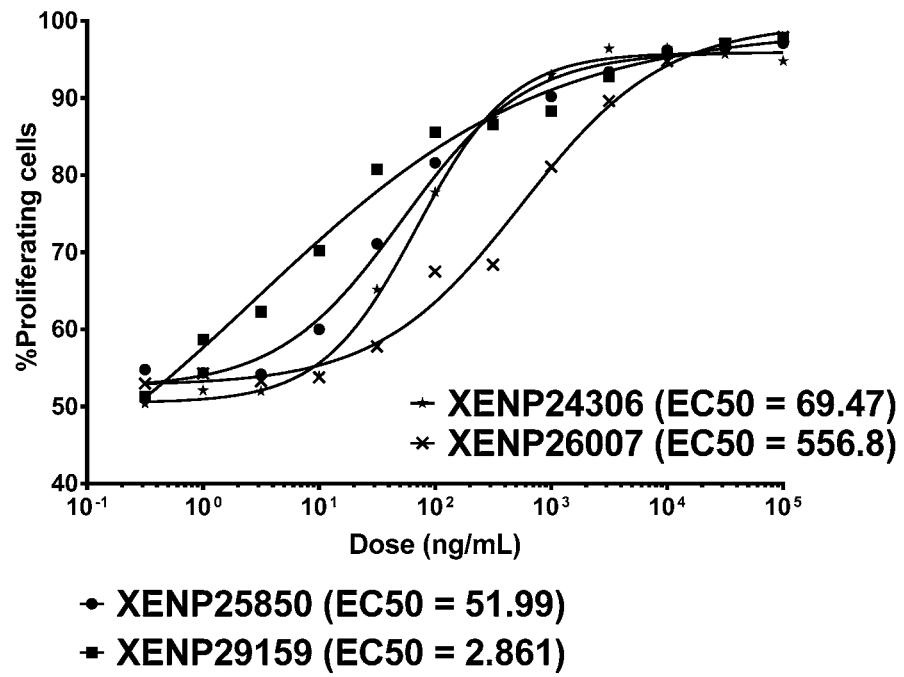
Figure 111B:
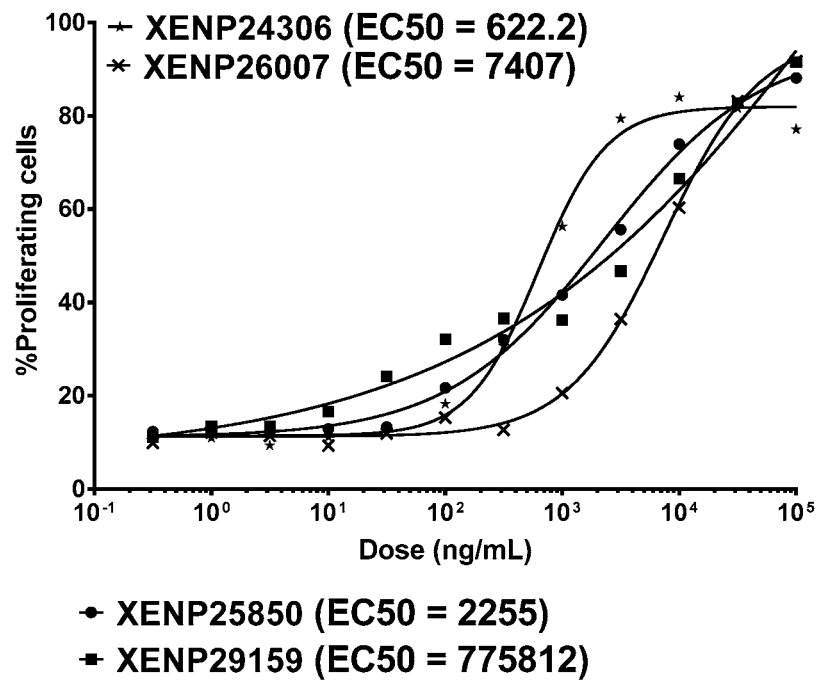

FIGS. 111A-111B depict induction of A) CD8 memory T cell and B) CD8 naive T cell proliferation by PD-1-targeted IL-15/Rα-Fc fusions (and controls) as indicated by percentage proliferating cells (determined based on CFSE dilution). The data show that PD-1-targeted IL-15/Rα-Fc fusions are more potent in inducing proliferation of CD8 memory T cells in comparison to untargeted IL-15(D30N/E64Q/N65D)/Rα-Fc fusion (as well as control RSV-targeted IL-15/Rα-Fc fusion). Notably, XENP29159 which has a higher-affinity PD-1 binding domain was more potent than XENP25850 in proliferation of CD8 memory T cells.

Figure 112A:
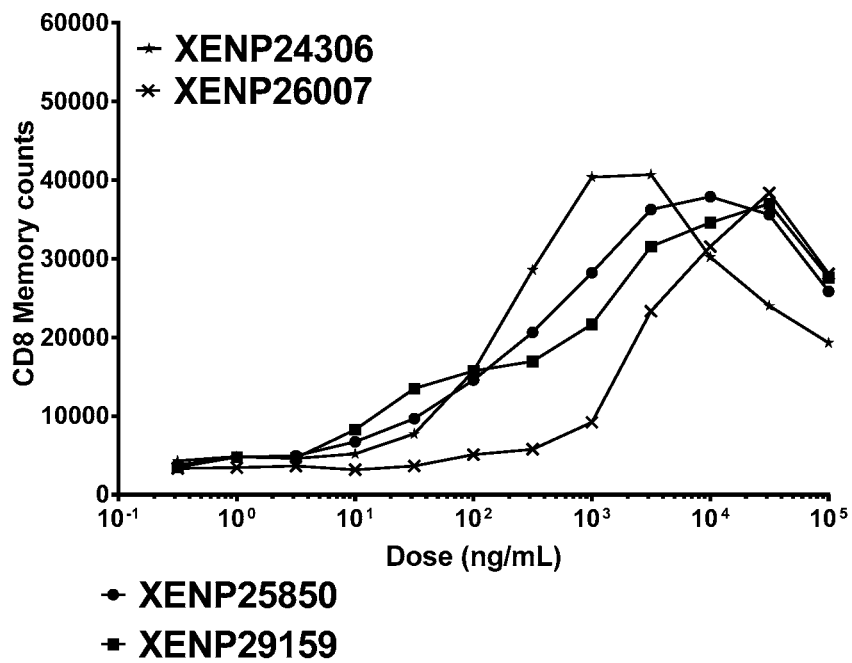
Figure 112B:
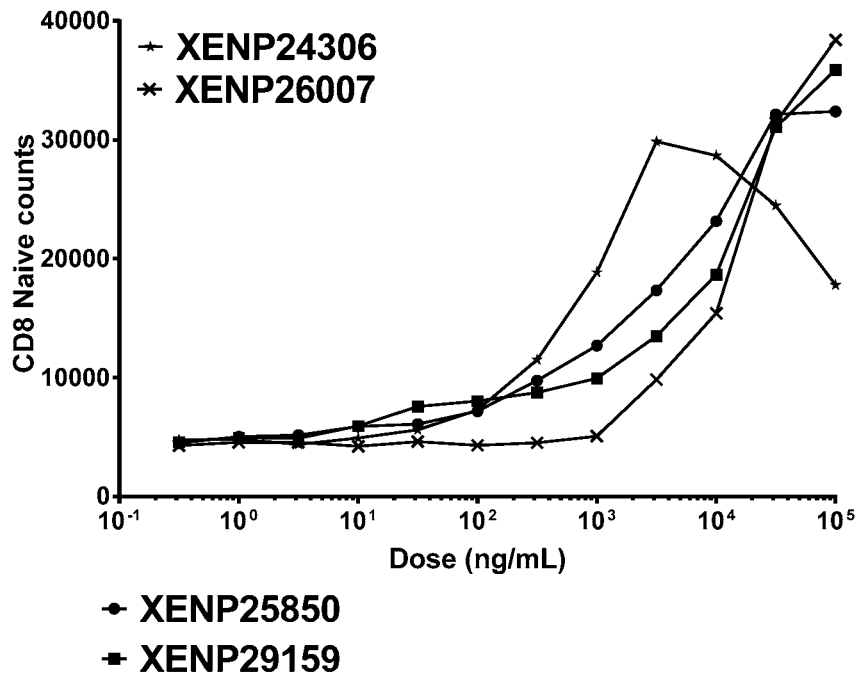

FIGS. 112A-112B depict induction of A) CD8 memory T cell and B) CD8 naive T cell proliferation by PD-1-targeted IL-15/Rα-Fc fusions (and controls) as indicated by cell counts.

Figure 113A:
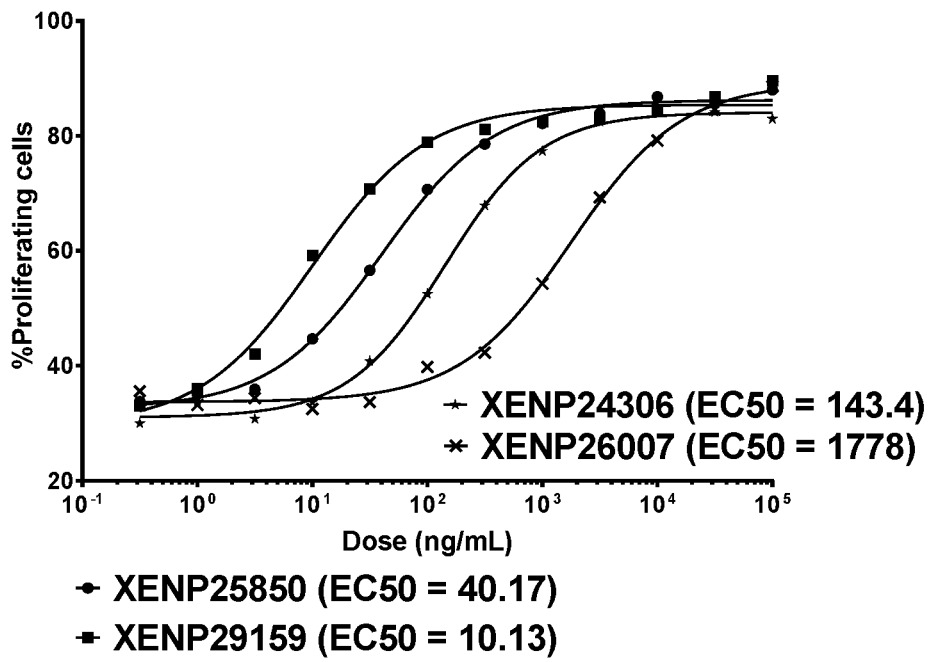
Figure 113B:
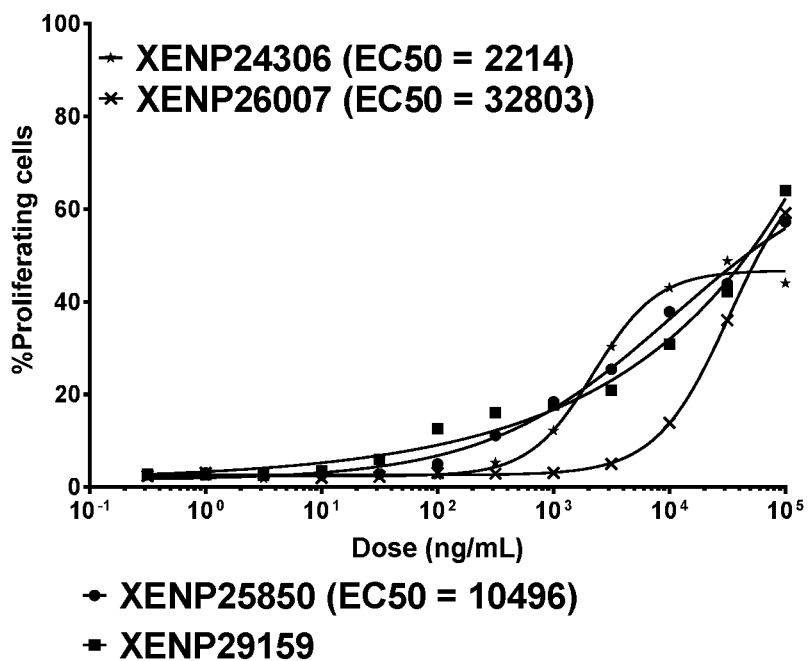

FIGS. 113A-113B depict induction of A) CD4 memory T cell and B) CD4 naive T cell proliferation by PD-1-targeted IL-15/Rα-Fc fusions (and controls) as indicated by percentage proliferating cells (determined based on CFSE dilution). The data show that PD-1-targeted IL-15/Rα-Fc fusions are more potent in inducing proliferation of CD4 memory T cells in comparison to untargeted IL-15(D30N/E64Q/N65D)/Rα-Fc fusion (as well as control RSV-targeted IL-15/Rα-Fc fusion). Notably, XENP29159 which has a higher-affinity PD-1 binding domain was more potent than XENP25850 in proliferation of CD4 memory T cells.

Figure 114A:
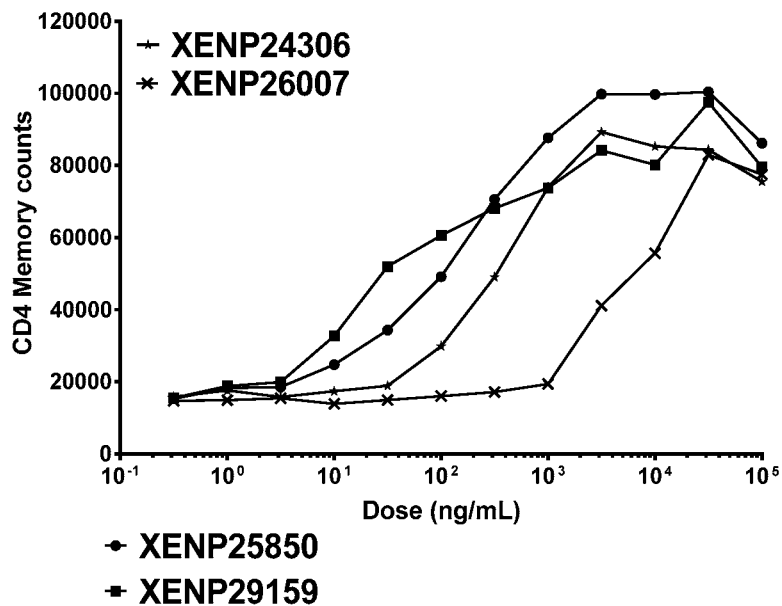
Figure 114B:
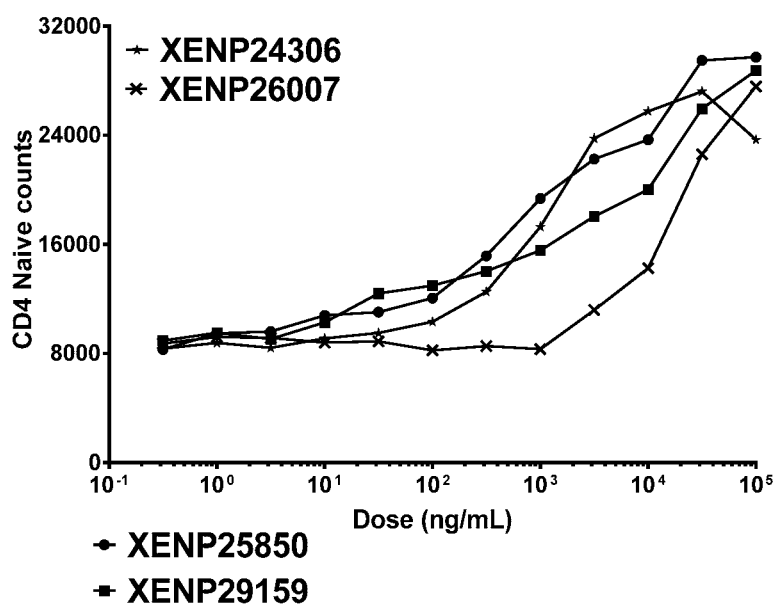

FIGS. 114A-114B depict induction of A) CD4 memory T cell and B) CD4 naive T cell proliferation by PD-1-targeted IL-15/Rα-Fc fusions (and controls) as indicated by cell counts. The data show that PD-1-targeted IL-15/Rα-Fc fusions are more potent in expanding CD4 memory T cells in comparison to untargeted IL-15(D30N/E64Q/N65D)/Rα-Fc fusion (as well as control RSV-targeted IL-15/Rα-Fc fusion). Notably, XENP29159 which has a higher-affinity PD-1 binding domain was more potent than XENP25850 in proliferation of CD4 memory T cells.

Figures 115A, 115B:
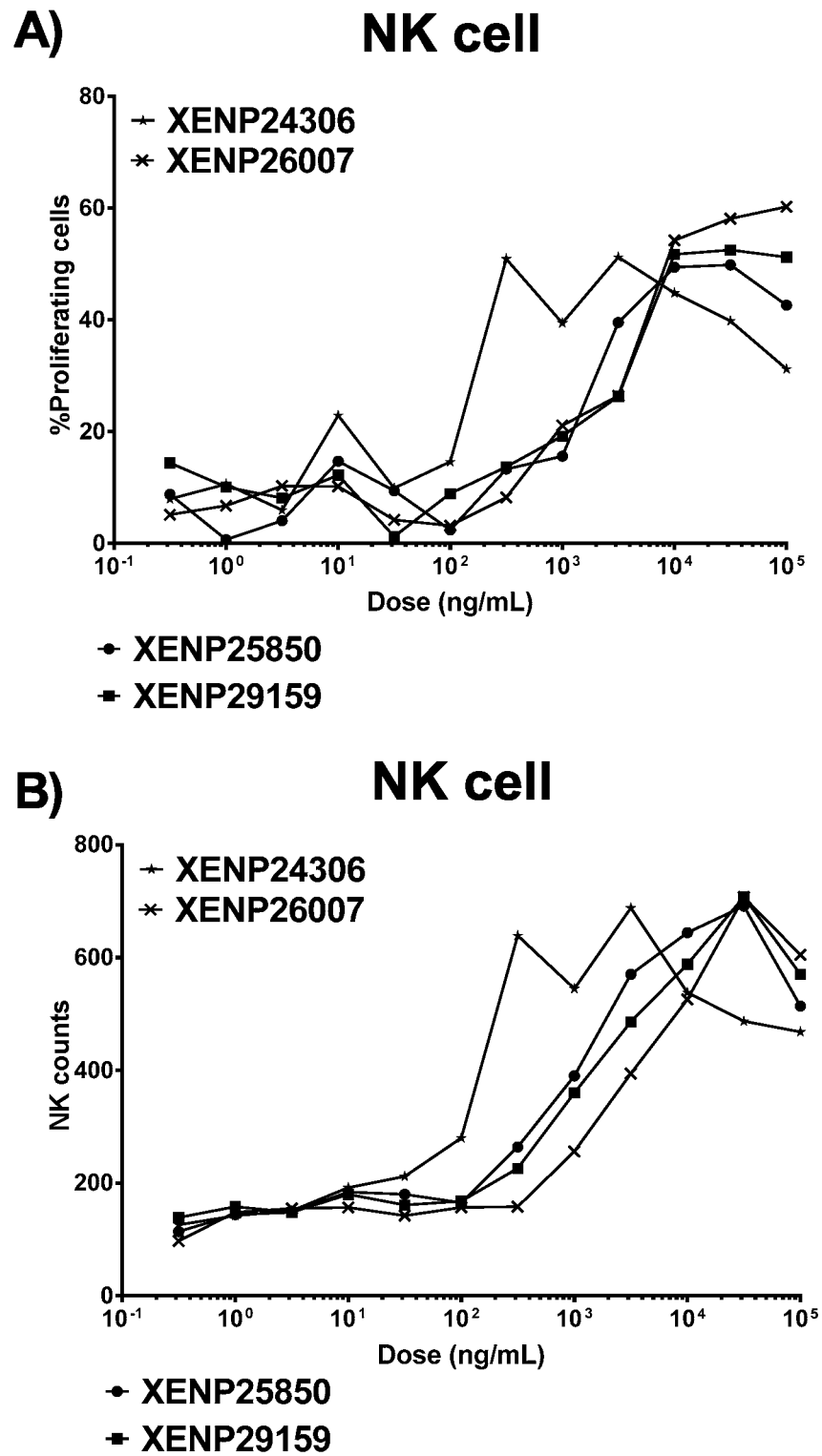
Figures 116A, 116B, 116C, 116D:
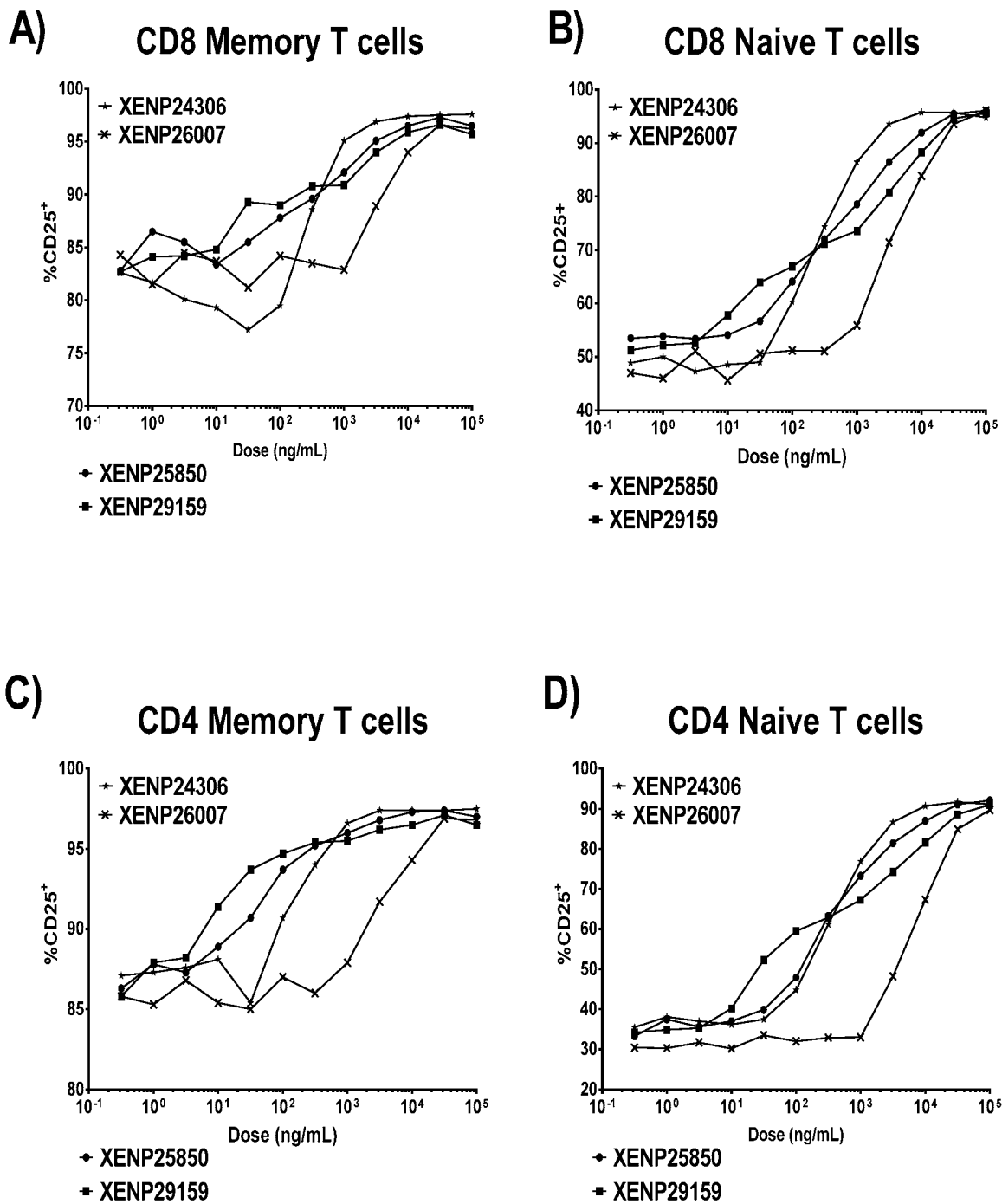
Figures 117A, 117B, 117C, 117D:
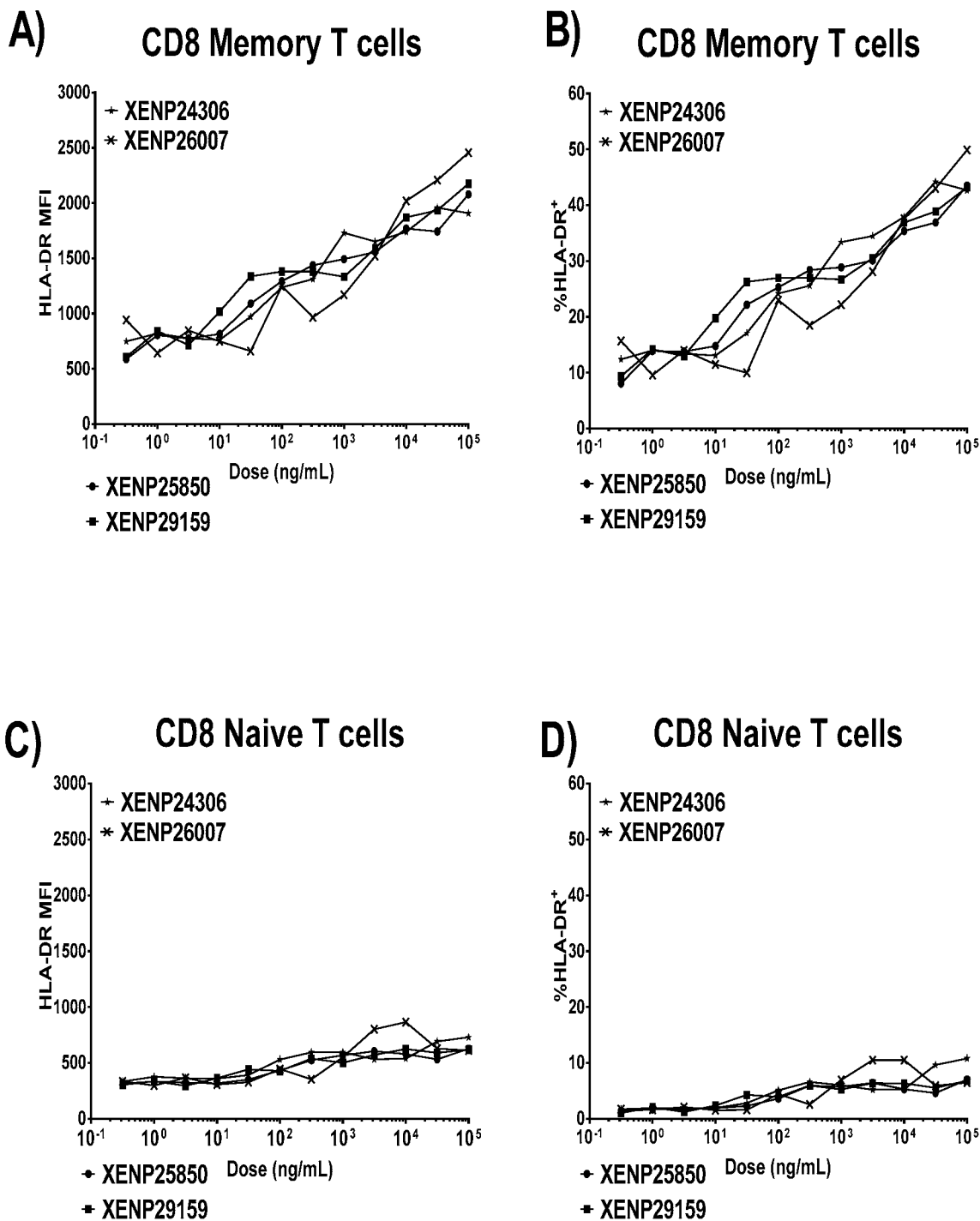
Figures 118A, 118B, 118C, 118D:
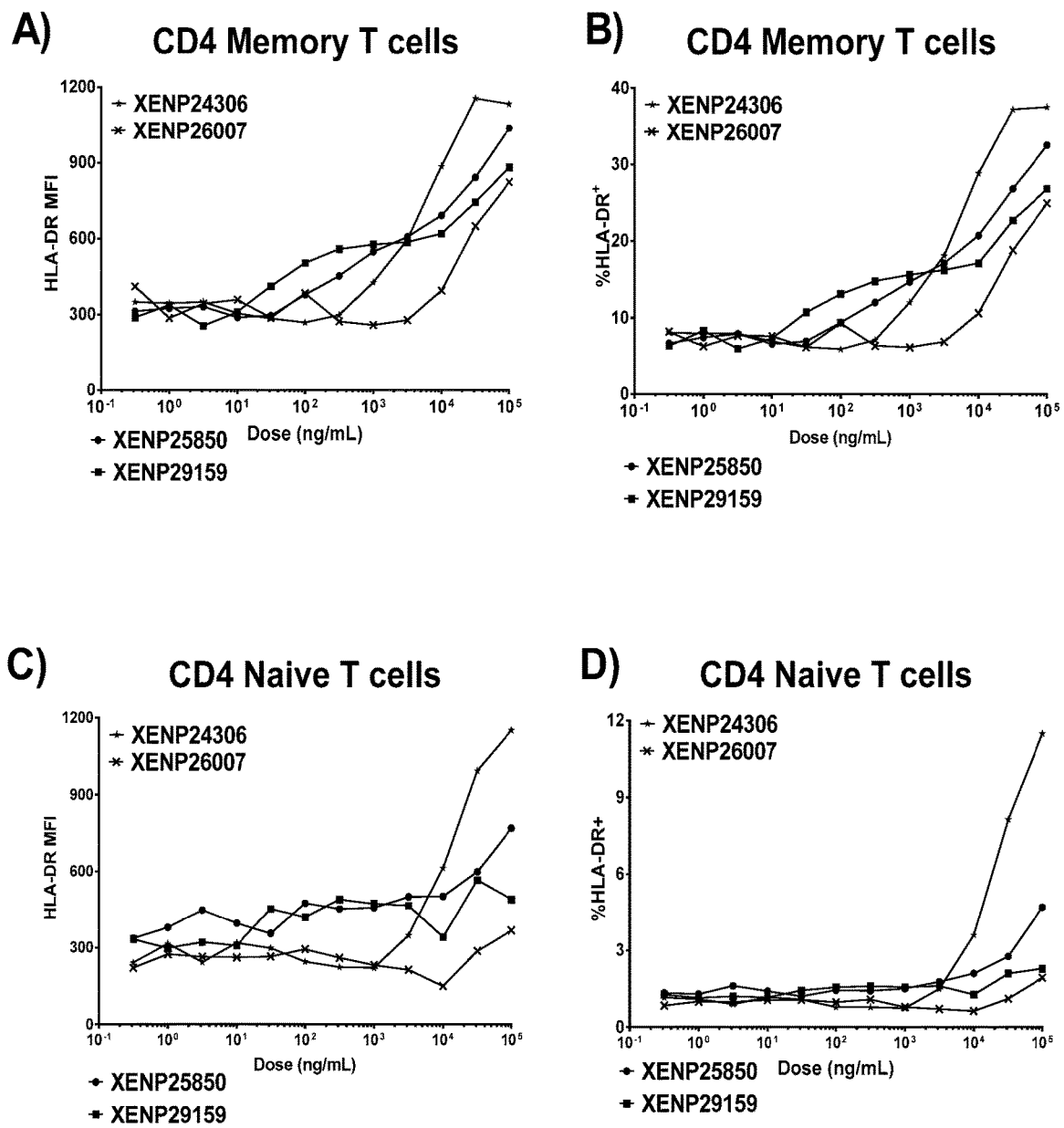

FIGS. 115A-115B depict induction of NK cells proliferation by PD-1-targeted IL-15/Rα-Fc fusions (and controls) as indicated A) by percentage proliferating cells (determined based on CFSE dilution) and B) by cell counts.

FIGS. 116A-116D depict activation of T cells as indicated by A) percentage CD8 memory T cells expressing CD25, B) percentage CD8 naive T cells expressing CD25, C) percentage CD4 memory T cells expressing CD25, and D) percentage CD4 naive T cells expressing CD25 following incubation with PD-1-targeted IL-15/Rα-Fc fusions (and controls). The data show that PD-1-targeted IL-15/Rα-Fc fusions appear to upregulate CD25 on CD8+ and CD4+ T cells more potently in comparison to untargeted IL-15(D30N/E64Q/N65D)/Rα-Fc fusion (as well as control RSV-targeted IL-15/Rα-Fc fusion).

FIGS. 117A-117D depict activation of CD8+ T cells as indicated by A) HLA-DR MFI on CD8 memory T cells, B) percentage CD8 memory T cells expressing HLA-DR, C) HLA-DR MFI on CD8 naive T cells, and D) percentage CD8 naive T cells expressing HLA-DR following incubation with PD-1-targeted IL-15/Rα-Fc fusions (and controls).

FIGS. 118A-118D depict activation of CD4+ T cells as indicated by A) HLA-DR MFI on CD4 memory T cells, B) percentage CD4 memory T cells expressing HLA-DR, C) HLA-DR MFI on CD4 naive T cells, and D) percentage CD4 naive T cells expressing HLA-DR following incubation with PD-1-targeted IL-15/Rα-Fc fusions (and controls).

FIG. 119 depicts the sequences of XENP22853, an IL-15/Rα-heteroFc fusion comprising a wild-type IL-15 and Xtend Fc (M428L/N434S) variant. IL-15 and IL-15Rα(sushi) are underlined, linkers are double underlined (although as will be appreciated by those in the art, the linkers can be replaced by other linkers, some of which are depicted in FIG. 9 and FIG. 10, and slashes (/) indicate the border(s) between IL-15, IL-15Rα, linkers, and constant/Fc regions.

FIG. 120 depicts the sequences of XENP4113, an IL-15/Rα-heteroFc fusion comprising a IL-15(N4D/N65D) variant and Xtend Fc (M428L/N434S) variant. IL-15 and IL-15Rα (sushi) are underlined, linkers are double underlined (although as will be appreciated by those in the art, the linkers can be replaced by other linkers, some of which are depicted in FIG. 9 and FIG. 10, and slashes (/) indicate the border(s) between IL-15, IL-15Rα, linkers, and constant/Fc regions.

FIG. 121 depicts the sequences of XENP24294, an scIL-15/Rα-Fc fusion comprising an IL-15(N4D/N65D) variant and Xtend Fc (M428L/N434S) substitution. IL-15 and IL-15Rα(sushi) are underlined, linkers are double underlined (although as will be appreciated by those in the art, the linkers can be replaced by other linkers, some of which are depicted in FIG. 9 and FIG. 10, and slashes (/) indicate the border(s) between IL-15, IL-15Rα, linkers, and constant/Fc regions.

FIG. 122 depicts the sequences of XENP24306, an IL-15/Rα-heteroFc fusion comprising an IL-15(D30N/E64Q/N65D) variant and Xtend Fc (M428L/N434S) substitution. IL-15 and IL-15Rα(sushi) are underlined, linkers are double underlined (although as will be appreciated by those in the art, the linkers can be replaced by other linkers, some of which are depicted in FIG. 9 and FIG. 10, and slashes (/) indicate the border(s) between IL-15, IL-15Rα, linkers, and constant/Fc regions.

Figure 123:
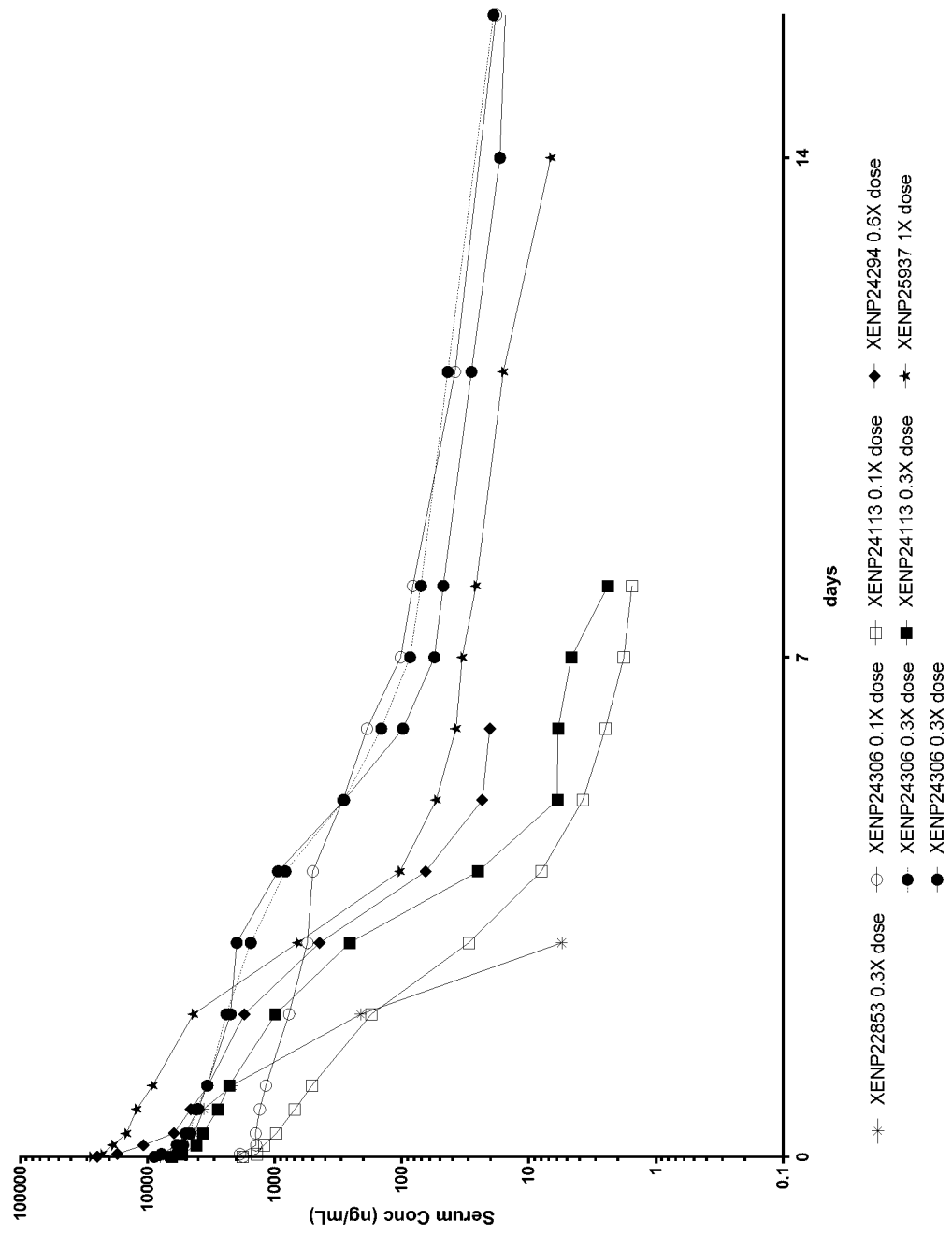
Figure 125A:
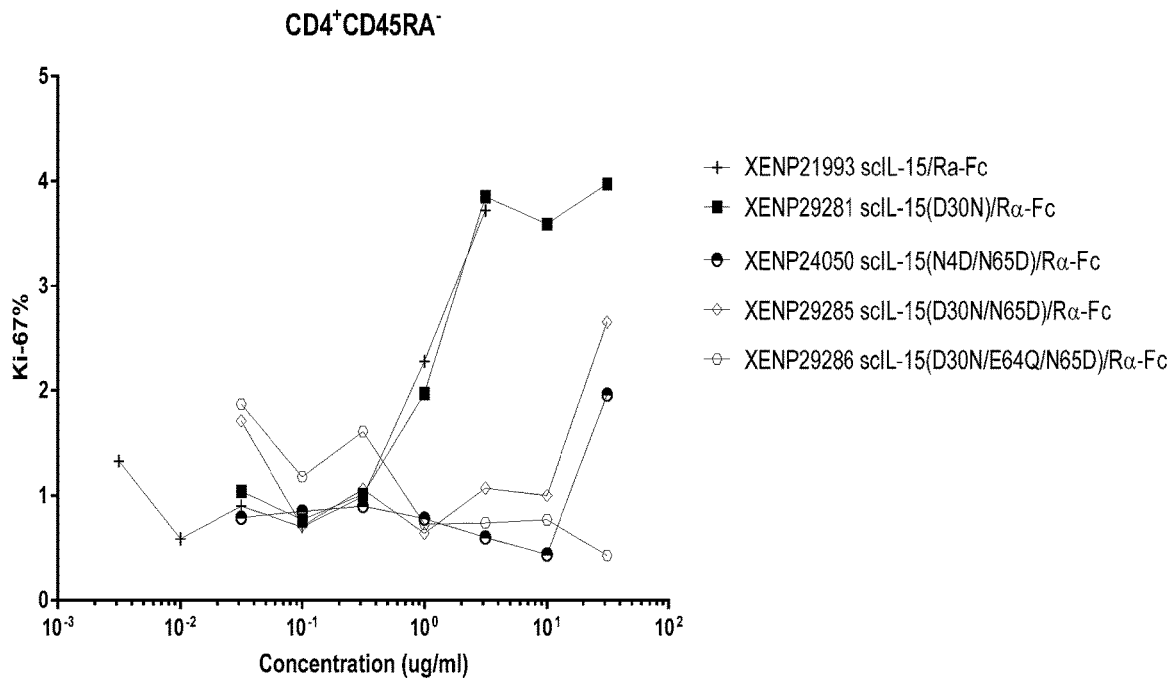
Figure 125B:
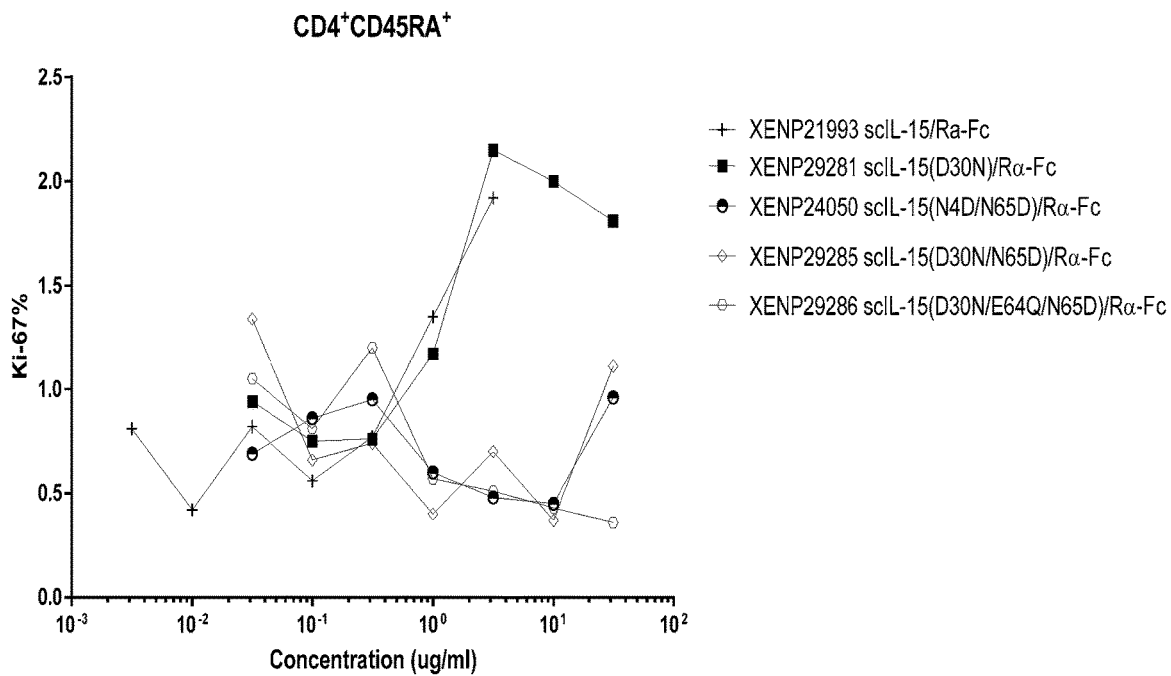
Figure 125C:
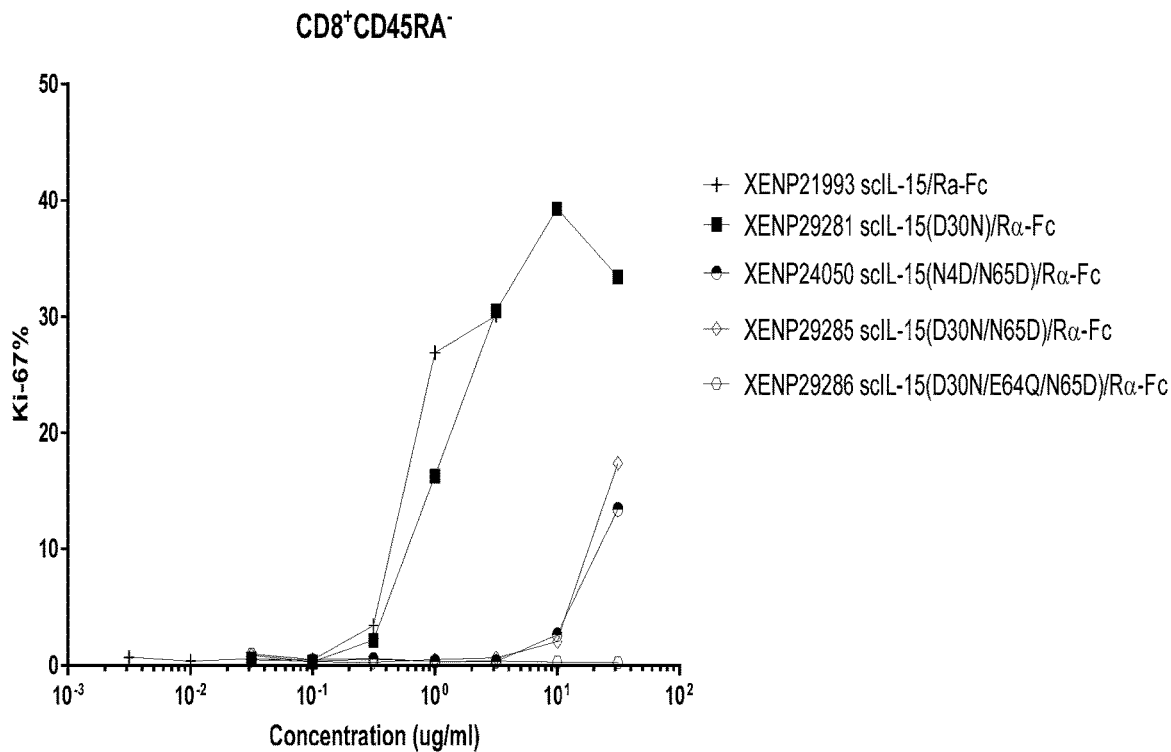
Figure 125D:
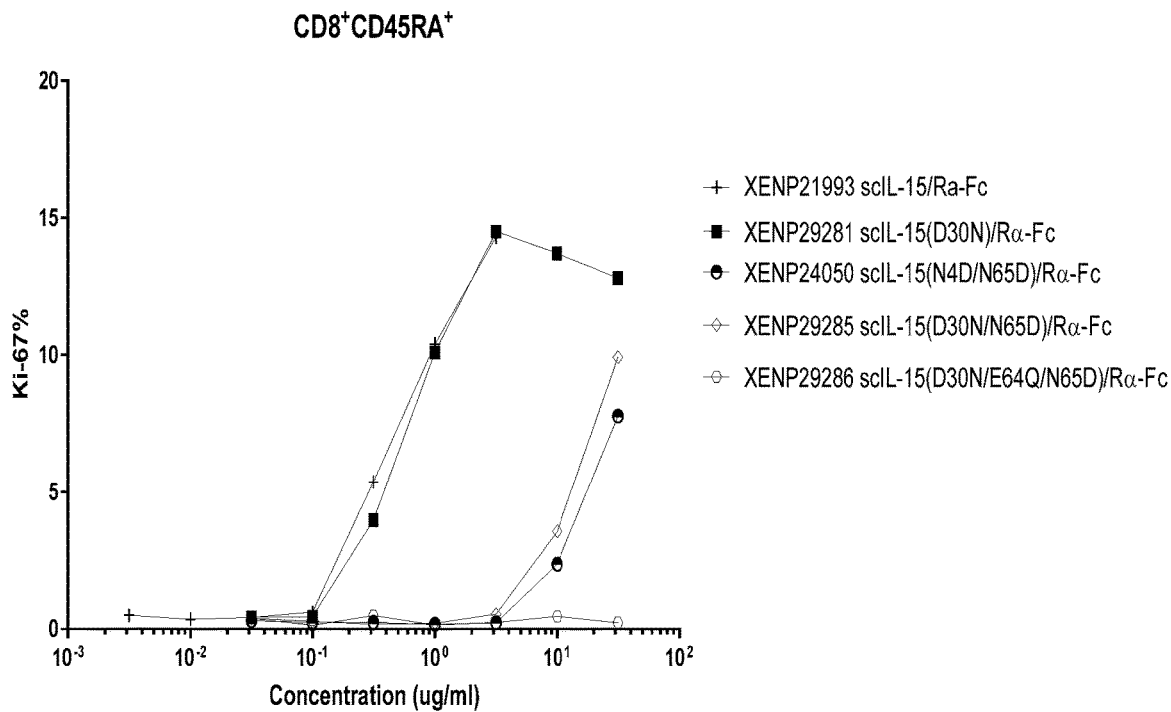
Figure 125E:
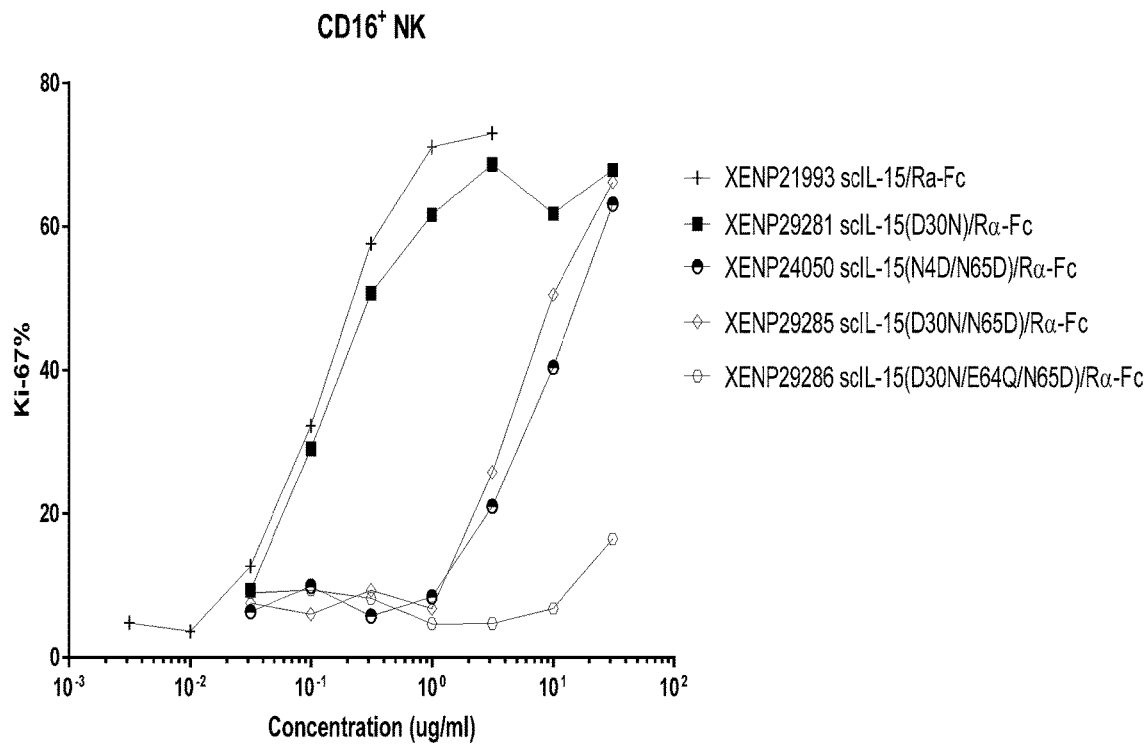
Figure 125F:
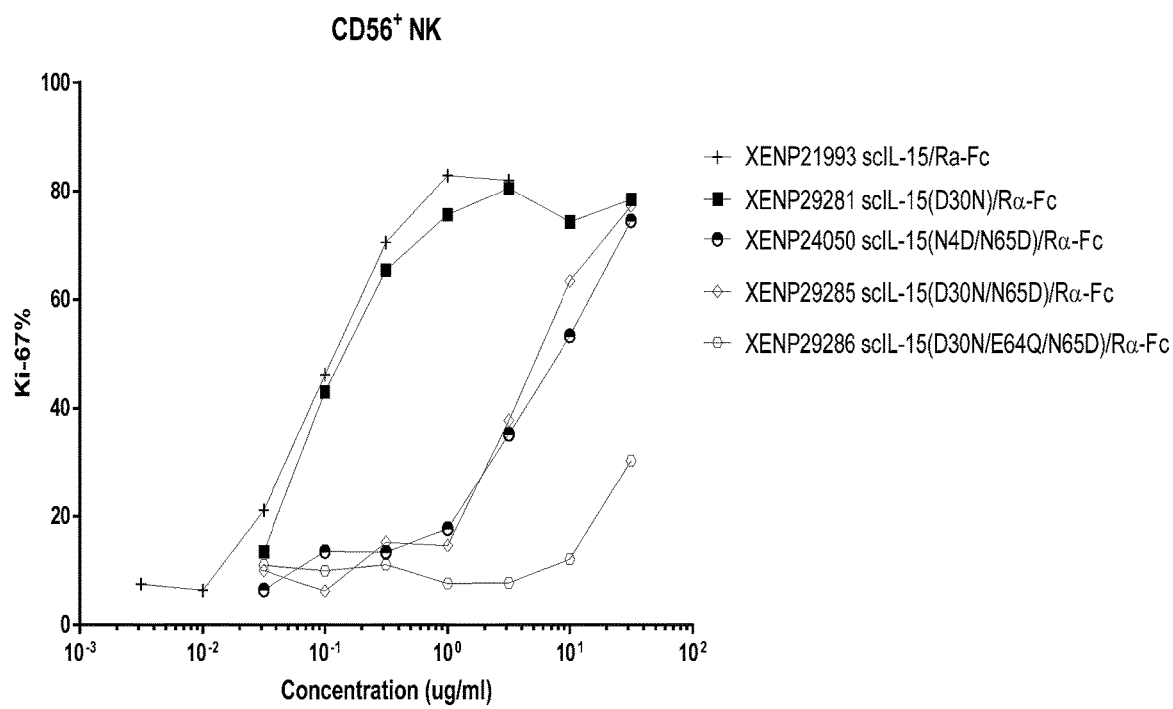
Figure 125G:
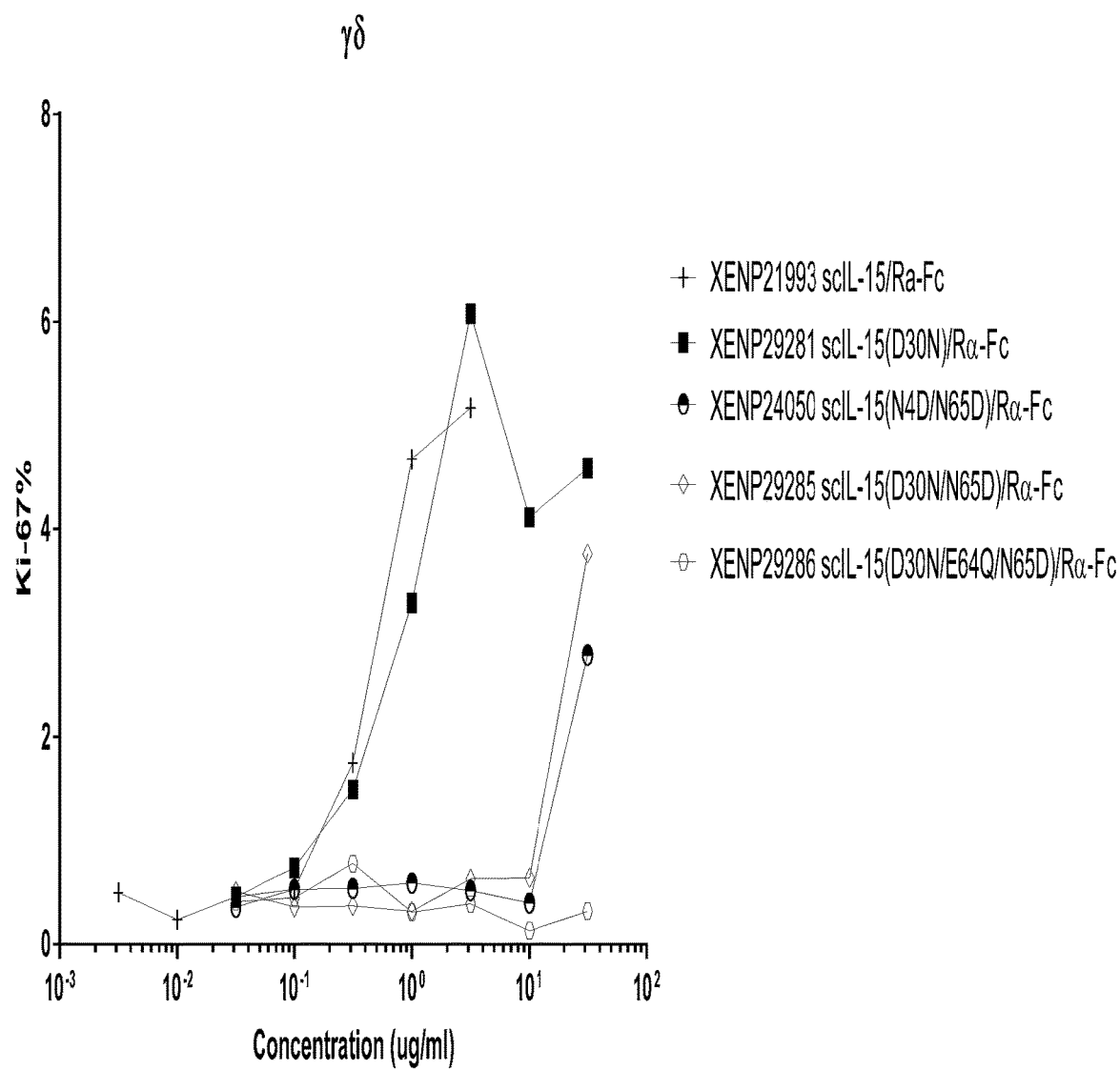

FIG. 123 depicts the serum concentration of the indicated test articles over time in cynomolgus monkeys following a first dose at the indicated relative concentrations.

FIGS. 124A-124C depict sequences of illustrative scIL-15/Rα-Fc fusions comprising additional IL-15 potency variants. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions. Additionally, each component of the scIL-15/Rα-Fc fusion protein has its own SEQ ID NO: in the sequence listing.

FIGS. 125A-125G depict percentage of A) CD4+CD45RA−, B) CD4+CD45RA+, C) CD8+CD45RA−, D) CD8+CD45RA+, E) CD16+ NK cells, F) CD56+ NK cells, and G) γδ cells expression Ki67 following incubation of PBMCs with the indicated test articles for 3 days.

FIGS. 126A-126D depict sequences of illustrative PD-1-targeted IL-15/Rα-Fc fusions comprising IL-15(D30N/N65D) variant. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s)

between IL-15, IL-15Rα, linkers, variable regions, and constant/Fc regions. Additionally, each CDR has its own SEQ ID NO: in the sequence listing, and each VL domain has its own SEQ ID NO: in the sequence listing.

FIGS. 127A-127D depict sequences of illustrative PD-1-targeted IL-15/Rα-Fc fusions comprising IL-15(D30N/E64Q/N65D) variant. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions. Additionally, each CDR has its own SEQ ID NO: in the sequence listing, and each VL domain has its own SEQ ID NO: in the sequence listing.

FIGS. 128A-128L depict sequences of illustrative PD-1-targeted IL-15/Rα-Fc fusions comprising Xtend (M428L/N434S) substitutions for enhancing serum half-life. The CDRs are in bold. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are underlined, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions. It should be noted that any of the sequences depicted herein may include or exclude the M428L/N434S substitutions. Additionally, each CDR has its own SEQ ID NO: in the sequence listing, and each VL domain has its own SEQ ID NO: in the sequence listing.

FIGS. 129A-129B depict the sequences of XENP26007, XENP29481, and XENP30432, control RSV-targeted IL-15/Rα-Fc fusions. The CDRs are underlined. As noted herein and is true for every sequence herein containing CDRs, the exact identification of the CDR locations may be slightly different depending on the numbering used as is shown in Table 1, and thus included herein are not only the CDRs that are in bold but also CDRs included within the $V_H$ and $V_L$ domains using other numbering systems. IL-15 and IL-15Rα(sushi) are italicized, linkers are double underlined (although as will be appreciated by those in the art, the linkers can be replaced by other linkers, some of which are depicted in FIG. 9 and FIG. 10), and slashes (/) indicate the border(s) between IL-15, IL-15Rα, linkers, variable regions, and constant/Fc regions. Additionally, each CDR has its own SEQ ID NO: in the sequence listing, and each VL domain has its own SEQ ID NO: in the sequence listing.

DETAILED DESCRIPTION OF THE INVENTION

I. Incorporation of Materials

A. Figures and Legends

All the figures, accompanying legends and sequences (with their identifiers and/or descriptions) of U.S. Provisional Application No. 62/659,571 filed Apr. 18, 2018, and International Application No. WO2018/071918 filed Oct. 16, 2017, and U.S. Patent Application No. 2018/0118828 filed Oct. 16, 2017, all which are expressly and independently incorporated by reference herein in their entirety, particularly the amino acid sequences depicted therein.

Additional IL-15/IL-15Rα heterodimeric Fc fusion proteins are described in detail, for example, in U.S. Provisional Application titled "IL-15/IL-Ra Heterodimeric Fc Fusion Proteins and Uses Thereof" and filed concurrently, U.S. Provisional Application No. 62/408,655, filed Oct. 14, 2016, U.S. Provisional Application No. 62/416,087, filed Nov. 1, 2016, U.S. Provisional Application No. 62/443,465, filed Jan. 6, 2017, U.S. Provisional Application No. 62/477,926, filed Mar. 28, 2017, U.S. patent application Ser. No. 15/785,401, filed on Oct. 16, 2017, and PCT International Application No. PCT/US2017/056829, filed on Oct. 16, 2017, which are expressly incorporated herein by reference in their entirety, with particular reference to the figures, legends and claims therein.

Additional PD-1-targeted IL-15/IL-15Rα-Fc fusion proteins are described in detail, for example, in U.S. Provisional Application No. 62/408,655, filed on Oct. 14, 2016, U.S. Provisional Application No. 62/416,087, filed on Nov. 1, 2016, U.S. Provisional Application No. 62/443,465, filed on Jan. 6, 2017, U.S. Provisional Application No. 62/477,926, filed on Mar. 28, 2017, U.S. patent application Ser. No. 15/785,393, filed on Oct. 16, 2017, and PCT International Application No. PCT/US2017/056826, filed on Oct. 16, 2017, which are expressly incorporated herein by reference in their entirety, with particular reference to the figures, legends and claims therein.

B. Sequences

Reference is made to the accompanying sequence listing as following: anti-PD-1 sequences suitable for use as ABDs include SEQ ID NOS of the PD-1 scFv sequences of FIGS. 93A-93S, although the Fv sequences therein can be formatted as scFvs) and SEQ ID NOS of the PD-1 Fab sequences of FIGS. 94A-94AP, although the Fab sequences therein can be formatted as scFvs). As will be understood from those in the art, these sequence identifiers come in "pairs" for the variable heavy and light chains, as will be apparent from the sequence identifiers.

IL-15 sequences suitable for use in the PD-1-targeted IL-15/IL-15Rα-Fc fusion proteins include the SEQ ID NO of human mature IL-15 of FIG. 3A, the SEQ ID NO of human mature IL-15 of FIG. 3A having amino acid substitutions N4D/N65D, the SEQ ID NO: of human mature IL-15 of FIG. 3A having amino acid substitutions D30N/N65D, and the SEQ ID NO: of human mature IL-15 of FIG. 3A having amino acid substitutions D30N/E64Q/N65D. In some embodiments, the IL-15 of the PD-1-targeted IL-15/IL-15Rα-Fc fusion protein of the invention includes the SEQ ID NO of human mature IL-15 of FIG. 3A having one or more amino acid substitutions selected from the group consisting of N1D, N4D, D8N, D30N, D61N, E64Q, N65D, Q108E, and those depicted in FIGS. 44A-44C and the corresponding sequence identifiers. IL-15 Rα sequences suitable for use in the PD-1-targeted IL-15/IL-15Rα-Fc fusion proteins include the SEQ ID NO of human IL-15Rα (sushi) domain of FIG. 3A.

C. Nomenclature

The PD-1-targeted IL-15/IL-15Rα-Fc fusion proteins of the invention are listed in several formats. In some cases, a polypeptide is given a unique "XENP" number (or in some cases, a "XENCS" number), although as will be appreciated in the art, a longer sequence might contain a shorter one.

These XENP numbers are in the sequence listing as well as identifiers, and used in the Figures. In addition, one molecule, comprising the three components, gives rise to multiple sequence identifiers. For example, the listing of the Fab monomer has the full length sequence, the variable heavy sequence and the three CDRs of the variable heavy sequence; the light chain has a full length sequence, a variable light sequence and the three CDRs of the variable light sequence; and the scFv-Fc domain has a full length sequence, an scFv sequence, a variable light sequence, 3 light CDRs, a scFv linker, a variable heavy sequence and 3 heavy CDRs. In some cases, molecules herein with a scFv domain use a single charged scFv linker (+H), although others can be used. In addition, the naming nomenclature of particular variable domains uses a "Hx.xx_Ly.yy" type of format, with the numbers being unique identifiers to particular variable chain sequences. Thus, the variable domain of the Fab side of XENP25937 is "1C11[PD-1]_H3L3", which indicates that the variable heavy domain H3 was combined with the light domain L3. In the case of scFv sequences such as XENP25812, the designation "1C11_H3.240_L3.148", indicates that the variable heavy domain H3.240 was combined with the light domain L3.148 and is in vh-linker-vl orientation, from N- to C-terminus. This molecule with the identical sequences of the heavy and light variable domains but in the reverse order would be named "1C11_L3.148_H3.240". Similarly, different constructs may "mix and match" the heavy and light chains as will be evident from the sequence listing and the Figures.

II. Definitions

In order that the application may be more completely understood, several definitions are set forth below. Such definitions are meant to encompass grammatical equivalents.

By "ablation" herein is meant a decrease or removal of activity. Thus for example, "ablating FcγR binding" means the Fc region amino acid variant has less than 50% starting binding as compared to an Fc region not containing the specific variant, with less than 70-80-90-95-98% loss of activity being preferred, and in general, with the activity being below the level of detectable binding in a Biacore assay. Of particular use in the ablation of FcγR binding are those shown in FIG. 6. However, unless otherwise noted, the Fc monomers of the invention retain binding to the FcRn receptor.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "ADCP" or antibody dependent cell-mediated phagocytosis as used herein is meant the cell-mediated reaction wherein nonspecific cytotoxic cells that express FcγRs recognize bound antibody on a target cell and subsequently cause phagocytosis of the target cell.

By "antigen binding domain" or "ABD" herein is meant a set of six Complementary Determining Regions (CDRs) that, when present as part of a polypeptide sequence, specifically binds a target antigen as discussed herein. Thus, a "checkpoint antigen binding domain" binds a target checkpoint antigen as outlined herein. As is known in the art, these CDRs are generally present as a first set of variable heavy CDRs (vhCDRs or $V_H$CDRs) and a second set of variable light CDRs (vlCDRs or $V_L$CDRs), each comprising three CDRs: vhCDR1, vhCDR2, vhCDR3 for the heavy chain and vlCDR1, vlCDR2 and vlCDR3 for the light. The CDRs are present in the variable heavy and variable light domains, respectively, and together form an Fv region. Thus, in some cases, the six CDRs of the antigen binding domain are contributed by a variable heavy and variable light chain. In a "Fab" format, the set of 6 CDRs are contributed by two different polypeptide sequences, the variable heavy domain (vh or $V_H$; containing the vhCDR1, vhCDR2 and vhCDR3) and the variable light domain (vl or $V_L$; containing the vlCDR1, vlCDR2 and vlCDR3), with the C-terminus of the vh domain being attached to the N-terminus of the CH1 domain of the heavy chain and the C-terminus of the vl domain being attached to the N-terminus of the constant light domain (and thus forming the light chain). In a scFv format, the vh and vl domains are covalently attached, generally through the use of a linker as outlined herein, into a single polypeptide sequence, which can be either (starting from the N-terminus) vh-linker-vl or vl-linker-vh, with the former being generally preferred (including optional domain linkers on each side, depending on the format used (e.g., from FIG. 1 of U.S. 62/353,511).

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y refers to a variant polypeptide, in this case an Fc variant, in which the glutamic acid at position 272 is replaced with tyrosine. For clarity, a protein which has been engineered to change the nucleic acid coding sequence but not change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid sequence at a particular position in a parent polypeptide sequence. For example, –233E or 233E designates an insertion of glutamic acid after position 233 and before position 234. Additionally, –233ADE or A233ADE designates an insertion of AlaAspGlu after position 233 and before position 234.

By "amino acid deletion" or "deletion" as used herein is meant the removal of an amino acid sequence at a particular position in a parent polypeptide sequence. For example, E233- or E233 #, E233( ) or E233del designates a deletion of glutamic acid at position 233. Additionally, EDA233- or EDA233 # designates a deletion of the sequence GluAspAla that begins at position 233.

By "variant protein" or "protein variant", or "variant" as used herein is meant a protein that differs from that of a parent protein by virtue of at least one amino acid modification. Protein variant may refer to the protein itself, a composition comprising the protein, or the amino acid sequence that encodes it. Preferably, the protein variant has at least one amino acid modification compared to the parent protein, e.g. from about one to about seventy amino acid modifications, and preferably from about one to about five amino acid modifications compared to the parent. As described below, in some embodiments the parent polypeptide, for example an Fc parent polypeptide, is a human wild type sequence, such as the Fc region from IgG1, IgG2, IgG3 or IgG4, although human sequences with variants can also serve as "parent polypeptides", for example the IgG1/2 hybrid can be included. The protein variant sequence herein will preferably possess at least about 80% identity with a parent protein sequence, and most preferably at least about 90% identity, more preferably at least about 95-98-99% identity. Variant protein can refer to the variant protein itself, compositions comprising the protein variant, or the DNA sequence that encodes it.

Accordingly, by "antibody variant" or "variant antibody" as used herein is meant an antibody that differs from a parent antibody by virtue of at least one amino acid modification, "IgG variant" or "variant IgG" as used herein is meant an antibody that differs from a parent IgG (again, in many cases, from a human IgG sequence) by virtue of at least one amino acid modification, and "immunoglobulin variant" or "variant immunoglobulin" as used herein is meant an immunoglobulin sequence that differs from that of a parent immunoglobulin sequence by virtue of at least one amino acid modification. "Fc variant" or "variant Fc" as used herein is meant a protein comprising an amino acid modification in an Fc domain as compared to an Fc domain of human IgG1, IgG2, IgG3 or IgG4. The Fc variants of the present invention are defined according to the amino acid modifications that compose them. Thus, for example, N434S or 434S is an Fc variant with the substitution serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as M428L/N434S, and so on. For all positions discussed in the present invention that relate to antibodies, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference.) The modification can be an addition, deletion, or substitution. Substitutions can include naturally occurring amino acids and, in some cases, synthetic amino acids. Examples include U.S. Pat. No. 6,586,207; WO 98/48032; WO 03/073238; US2004/0214988A1; WO 05/35727A2; WO 05/74524A2; J. W. Chin et al., (2002), Journal of the American Chemical Society 124:9026-9027; J. W. Chin, & P. G. Schultz, (2002), ChemBioChem 11:1135-1137; J. W. Chin, et al., (2002), PICAS United States of America 99:11020-11024; and, L. Wang, & P. G. Schultz, (2002), Chem. 1-10, all entirely incorporated by reference.

As used herein, "protein" herein is meant at least two covalently attached amino acids, which includes proteins, polypeptides, oligopeptides and peptides. In addition, polypeptides may include synthetic derivatization of one or more side chains or termini, glycosylation, PEGylation, circular permutation, cyclization, linkers to other molecules, fusion to proteins or protein domains, and addition of peptide tags or labels.

By "residue" as used herein is meant a position in a protein and its associated amino acid identity. For example, Asparagine 297 (also referred to as Asn297 or N297) is a residue at position 297 in the human antibody IgG1.

By "Fab" or "Fab region" as used herein is meant the polypeptide that comprises the VH, CH1, VL, and CL immunoglobulin domains. Fab may refer to this region in isolation, or this region in the context of a full length antibody, antibody fragment or Fab fusion protein. In the context of a Fab, the Fab comprises an Fv region in addition to the CH1 and CL domains.

By "Fv" or "Fv fragment" or "Fv region" as used herein is meant a polypeptide that comprises the VL and VH domains of a single antibody. As will be appreciated by those in the art, these generally are made up of two chains, or can be combined (generally with a linker as discussed herein) to form an scFv.

By "single chain Fv" or "scFv" herein is meant a variable heavy domain covalently attached to a variable light domain, generally using a scFv linker as discussed herein, to form a scFv or scFv domain. A scFv domain can be in either orientation from N to C-terminus (vh-linker-vl or vl-linker-vh). In the sequences depicted in the sequence listing and in the figures, the order of the vh and vl domain is indicated in the name, e.g. H.X_L.Y means N- to C-terminal is vh-linker-vl, and L.Y_H.X is vl-linker-vh.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et al., 2002, Immunological Reviews 190:123-136, entirely incorporated by reference). Fc ligands may include undiscovered molecules that bind Fc. Particular IgG Fc ligands are FcRn and Fc gamma receptors. By "Fc ligand" as used herein is meant a molecule, preferably a polypeptide, from any organism that binds to the Fc region of an antibody to form an Fc/Fc ligand complex.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc Receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin and the heavy chain is encoded by the FcRn gene. Unless otherwise noted herein, FcRn or an FcRn protein refers to the complex of FcRn heavy chain with beta-2-microglobulin. A variety of FcRn variants can be used to increase binding to the FcRn receptor, and in some cases, to increase serum half-life. In general, unless otherwise noted, the Fc monomers of the invention retain binding to the FcRn receptor (and, as noted below, can include amino acid variants to increase binding to the FcRn receptor).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it. Accordingly, by "parent immunoglobulin" as used herein is meant an unmodified immunoglobulin polypeptide that is modified to generate a variant, and by "parent antibody" as used herein is meant an unmodified antibody that is modified to generate a variant antibody. It should be noted that "parent antibody" includes known commercial, recombinantly produced antibodies as outlined below.

By "Fc" or "Fc region" or "Fc domain" as used herein is meant the polypeptide comprising the constant region of an antibody excluding the first constant region immunoglobulin domain (e.g., CH1) and in some cases, part of the hinge. Thus Fc refers to the last two constant region immunoglobulin domains (e.g., CH2 and CH3) of IgA, IgD, and IgG, the last three constant region immunoglobulin domains of IgE and IgM, and the flexible hinge N-terminal to these domains. For IgA and IgM, Fc may include the J chain. For IgG, the Fc domain comprises immunoglobulin domains Cγ2 and Cγ3 (Cγ2 and Cγ3) and the lower hinge region between Cγ1 (Cγ1) and Cγ2 (Cγ2). Although the boundaries of the Fc region may vary, the human IgG heavy chain Fc region is usually defined to include residues C226 or P230 to its carboxyl-terminus, wherein the numbering is according to the EU index as in Kabat. In some embodiments, as is more fully described below, amino acid modifications are made to the Fc region, for example to alter binding to one or more FcγR receptors or to the FcRn receptor.

By "heavy constant region" herein is meant the CH1-hinge-CH2-CH3 portion of an antibody.

By "Fc fusion protein" or "immunoadhesin" herein is meant a protein comprising an Fc region, generally linked (optionally through a linker moiety, as described herein) to a different protein, such as to IL-15 and/or IL-15R, as described herein. In some instances, two Fc fusion proteins can form a homodimeric Fc fusion protein or a heterodimeric Fc fusion protein with the latter being preferred. In some cases, one monomer of the heterodimeric Fc fusion protein comprises an Fc domain alone (e.g., an empty Fc domain) and the other monomer is a Fc fusion, comprising a variant Fc domain and a protein domain, such as a receptor, ligand or other binding partner.

By "position" as used herein is meant a location in the sequence of a protein. Positions may be numbered sequentially, or according to an established format, for example the EU index for antibody numbering.

By "strandedness" in the context of the monomers of the heterodimeric antibodies of the invention herein is meant that, similar to the two strands of DNA that "match", heterodimerization variants are incorporated into each monomer so as to preserve the ability to "match" to form heterodimers. For example, if some pI variants are engineered into monomer A (e.g., making the pI higher) then steric variants that are "charge pairs" that can be utilized as well do not interfere with the pI variants, e.g., the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "target antigen" as used herein is meant the molecule that is bound specifically by the variable region of a given antibody. A target antigen may be a protein, carbohydrate, lipid, or other chemical compound. A wide number of suitable target antigens are described below.

By "target cell" as used herein is meant a cell that expresses a target antigen.

By "variable region" as used herein is meant the region of an immunoglobulin that comprises one or more Ig domains substantially encoded by any of the Vκ, Vλ, and/or VH genes that make up the kappa, lambda, and heavy chain immunoglobulin genetic loci respectively.

By "wild type or WT" herein is meant an amino acid sequence or a nucleotide sequence that is found in nature, including allelic variations. A WT protein has an amino acid sequence or a nucleotide sequence that has not been intentionally modified.

The biospecific heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins having different binding specificities.

"Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

"Specific binding" or "specifically binds to" or is "specific for" a particular antigen or an epitope means binding that is measurably different from a non-specific interaction. Specific binding can be measured, for example, by determining binding of a molecule compared to binding of a control molecule, which generally is a molecule of similar structure that does not have binding activity. For example, specific binding can be determined by competition with a control molecule that is similar to the target.

Specific binding for a particular antigen or an epitope can be exhibited, for example, by an antibody having a KD for an antigen or epitope of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater, where KD refers to a dissociation rate of a particular antibody-antigen interaction. Typically, an antibody that specifically binds an antigen will have a KD that is 20-, 50-, 100-, 500-, 1000-, 5,000-, 10,000- or more times greater for a control molecule relative to the antigen or epitope.

Also, specific binding for a particular antigen or an epitope can be exhibited, for example, by an antibody having a KA or Ka for an antigen or epitope of at least 20-, 50-, 100-, 500-, 1000-, 5,000-, 10,000- or more times greater for the epitope relative to a control, where KA or Ka refers to an association rate of a particular antibody-antigen interaction. Binding affinity is generally measured using a Biacore assay.

III. Introduction

The invention provides targeted heterodimeric fusion proteins that can bind to the checkpoint inhibitor PD-1 antigen and can complex with the common gamma chain (γc; CD132) and/or the 11-2 receptor (3-chain (IL-2Rβ; CD122). In general, the heterodimeric fusion proteins of the invention have three functional components: an IL-15/IL-15Rα(sushi) component, generally referred to herein as an "IL-15 complex", an anti-PD-1 component, and an Fc component, each of which can take different forms and each of which can be combined with the other components in any configuration. The IL-15/IL-15Rα-Fc fusion protein can include as IL-15 protein covalently attached to an IL-15Rα, and an Fc domain. In some embodiments, the IL-15 protein and IL-15Rα protein are noncovalently attached.

As shown in the figures, the IL-15 complex can take several forms. As stated above, the IL-15 protein on its own is less stable than when complexed with the IL-15Rα protein. As is known in the art, the IL-15Rα protein contains a "sushi domain", which is the shortest region of the receptor that retains IL-15 binding activity. Thus, while heterodimeric fusion proteins comprising the entire IL-15Rα protein can be made, preferred embodiments herein include complexes that just use the sushi domain, the sequence of which is shown in the figures.

Figure 22A:
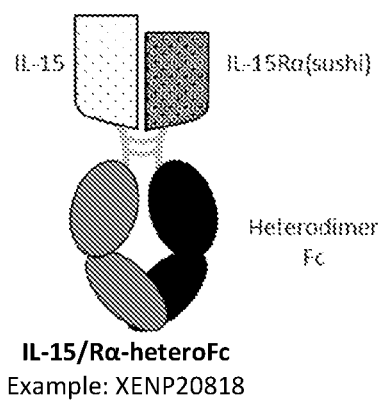
Figure 22B:
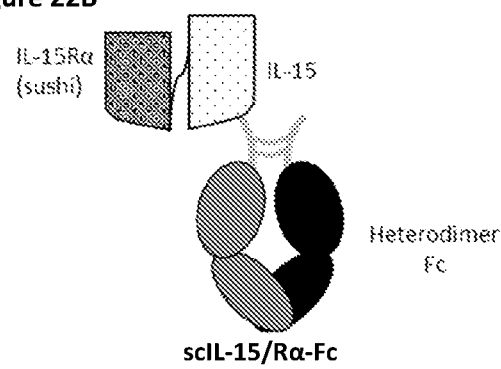
Figure 22C:
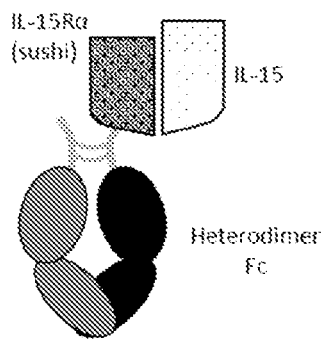
Figure 22D:
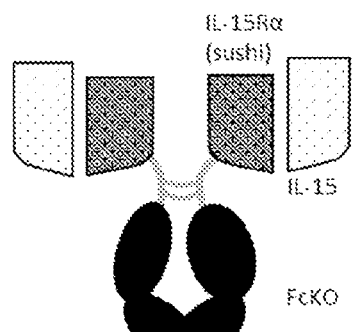
Figure 22E:
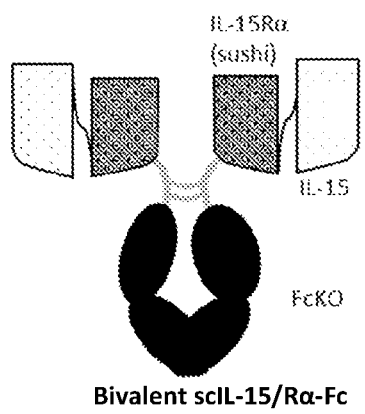
Figure 22F:
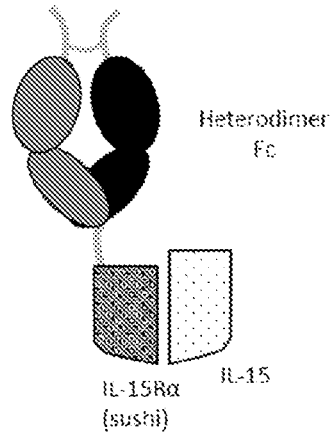
Figure 22G:
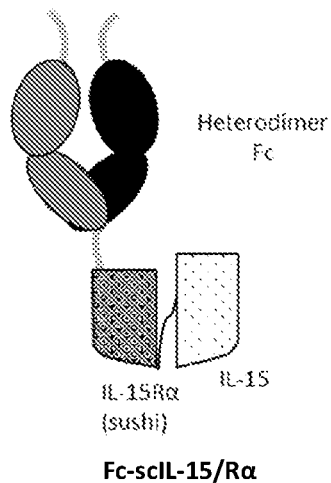

Accordingly, the IL-15 complex of the PD-1-targeted IL-15/Rα heterodimeric Fc fusion proteins of the invention generally comprises the human mature IL-15 protein (including human mature IL-15 protein variants) and the sushi domain of IL-15Rα (unless otherwise noted that the full length sequence is used, "IL-15Rα", "IL-15Rα(sushi)" and "sushi" are used interchangeably throughout). This complex can be used in multiple different formats. As shown in FIGS. 22A, 22C, 22D, and 22F, the IL-15 protein and the IL-15Rα (sushi) are not covalently attached, but rather are self-assembled through regular ligand-ligand interactions. As is more fully described herein, it can be either the IL-15 variant or the IL-15Rα sushi domain that is covalently linked to the Fc domain (generally using an optional domain linker). Amino acid sequences of the formats are provided in FIG. 23 ("IL-15/Rα-heteroFc" format), FIG. 24 ("scIL-15/Rα-Fc" format), FIGS. 25A-25B ("ncIL-15/Rα-Fc" format), FIG. 26 ("bivalent ncIL-15/Rα-Fc" format), FIG. 27 ("bivalent scIL-15/Rα-Fc" format), FIG. 28 ("Fc-ncIL-15/Rα" format), and FIG. 29 ("Fc-scIL-15/Rα" format). Alternatively, they can be covalently attached using a domain linker as generally shown in FIGS. 22B, 22E, and 22G. FIG. 22E depicts the sushi domain as the N-terminal domain, although this can be reversed. Finally, each of the IL-15 and IL-15Rα sushi domains can be engineered to contain a cysteine amino acid, that forms a disulfide bond to form the complex as is generally shown in FIGS. 36A, 36B, 36C, and 36D, again, with either the IL-15 domain or the IL-15Rα sushi domain being covalently attached (using an optional domain linker) to the Fc domain. Amino acid sequences of the formats are provided in FIGS. 37A-37B ("dsIL-15/Rα-heteroFc" format), FIG. 38A-38B ("dsIL-15/Rα-Fc" format), FIG. 39 ("bivalent dsIL-15/Rα-Fc" format), and FIG. 40 ("Fc-dsIL-15/Rα" format).

In some embodiments, the PD-1-targeted IL-15/Rα Fc fusion proteins have been engineered to exhibit reduced potency compared to their parental construct. For instance, one or more amino acid substitutions can be introduced into the amino acid sequence of the human mature IL-15 protein of the IL-15/Rα complex. In some embodiments, the PD-1-targeted IL-15/Rα Fc fusion protein of the invention comprises human mature IL-15 protein variant having amino acid substitutions N4D/N65D. In certain embodiments, the PD-1-targeted IL-15/Rα Fc fusion protein of the invention comprises human mature IL-15 protein variant having amino acid substitutions D30N/N65D. In particular embodiments, the PD-1-targeted IL-15/Rα Fc fusion protein of the invention comprises human mature IL-15 protein variant having amino acid substitutions D30N/E64Q/N65D. Exemplary embodiments of PD-1-targeted IL-15/Rα Fc fusion proteins with reduced potency and amino acid sequences thereof are provided in FIGS. 45A-45D, 46A-46C, 47A-47B, 48, 49, 50, 126, and 127.

A. PD-1 Antigen Binding Domains

The PD-1 antigen binding domain (ABD) (e.g., the anti-PD-1 component) of the invention is generally a set of 6 CDRs and/or a variable heavy domain and a variable light domain that form an Fv domain that can bind human PD-1. As shown herein, the anti-PD-1 ABD can be in the form of a scFv, wherein the vh and vl domains are joined using an scFv linker, which can be optionally a charged scFv linker. As will be appreciated by those in the art, the scFv can be assembled from N- to C-terminus as N-vh-scFv linker-vl-C or as N-vl-scFv linker-vh-C, with the C terminus of the scFv domain generally being linked to the hinge-CH2-CH3 Fc domain. Suitable Fvs (including CDR sets and variable heavy/variable light domains) can be used in scFv formats or Fab formats are shown in the Figures as well as disclosed in WO2017/218707 and PCT/US2018/059887 filed Nov. 8, 2018, hereby expressly incorporated in their entirety, and specifically for Figures, Legends, and SEQ identifiers that depict anti-PD-1 sequences. In some embodiments, PD-1 ABDs of the present invention are based on the 1C11 clone, shown in the Figures, specifically FIGS. 93A-93S and 94A-94AP. In some embodiments, PD-1 ABDs of the present invention are based on a variant heavy chain based on the heavy chain of 1C11 clone (XENP22553) shown in FIGS. 96A-96F. In some embodiments, PD-1 ABDs of the present invention are based on a variant light chain based on the light chain of 1C11 clone (XENP22553) shown in FIGS. 97A-97Q.

In useful embodiments, the PD-1-targeted IL-15/Rα Fc fusion proteins of the invention include an ABD to human PD-1. In some embodiments, the six CDRs that confer binding to PD-1 are selected from those depicted in any of FIGS. 93A-93S and 94A-94AP.

In some embodiments, the PD-1-targeted IL-15/Rα Fc fusion proteins of the invention include an ABD to human PD-1 in a scFv format. In some embodiments, ABD to human PD-1 contains the six CDRs that confer binding to PD-1 are selected from those depicted in any of FIGS. 93A-93S, or the VH and VL domain of any ABD of FIGS. 93A-93S.

In particular embodiments, the PD-1-targeted IL-15/Rα Fc fusion proteins of the invention include an ABD to human PD-1 in a Fab format. In some embodiments, ABD to human PD-1 contains the six CDRs that confer binding to PD-1 are selected from those depicted in any of FIGS. 94A-94AP, or the VH and VL domain of any ABD of FIGS. 94A-94AP. As will be understood from those in the art, these sequence identifiers come in "pairs" for the variable heavy and light chains, as will be apparent from the sequence identifiers.

In certain embodiments, the PD-1-targeted IL-15/Rα Fc fusion proteins of the invention include an ABD to human PD-1. In some instances, the CDRs of the variable heavy domain of the ABD are selected from those depicted in any of FIGS. 95A-95J and the CDRs of the variable light domain of the ABD are selected from those depicted in any of FIGS. 96A-96F.

Of particular use in many embodiments that have a scFv ABD to human PD-1 is the ABD of XENP25806 1C11[PD-1]_H3.234_L3.144 as depicted in FIG. 93R, including SEQ ID NOS: 578-579. Thus, the six CDRs and/or the VH and VL domains from XENP25806 (SEQ ID NOS: 578-579) can be used in the constructs of the invention.

Of particular use in many embodiments that have a scFv ABD to human PD-1 is the ABD of XENP25812 1C11[PD-1]_H3.240_L3.148 as depicted in FIG. 93R, including SEQ ID NO:584. Thus, the six CDRs and/or the VH and VL domains from XENP25812 (SEQ ID NO:584) can be used in the constructs of the invention.

Of particular use in many embodiments that have a scFv ABD to human PD-1 is the ABD of XENP25813 1C11[PD-1]_H3.241_L3.148 as depicted in FIG. 93R, including SEQ ID NO:585. Thus, the six CDRs and/or the VH and VL domains from XENP25813 (SEQ ID NO:585) can be used in the constructs of the invention.

Of particular use in many embodiments that have a scFv ABD to human PD-1 is the ABD of XENP25819 1C11[PD-1]_H3.241_L3.92 as depicted in FIG. 93S, including SEQ ID NO:591. Thus, the six CDRs and/or the VH and VL domains from XENP25819 (SEQ ID NO:591) can be used in the constructs of the invention.

Of particular use in many embodiments that have a Fab ABD to human PD-1 is the ABD of XENP26940 1C11[PD-1]_H3.303_L3.152 as depicted in FIG. 94N, including SEQ ID NOS:642 and 1103. Thus, the six CDRs and/or the VH and VL domains from XENP26940 (SEQ ID NOS:642 and 1103) can be used in the constructs of the invention.

Of particular use in many embodiments that have a Fab ABD to human PD-1 is the ABD of XENP28026 1C11[PD-1]_H3.329_L3.220 as depicted in FIG. 94AE, including SEQ ID NOS:708 and 1169. Thus, the six CDRs and/or the VH and VL domains from XENP28026 (SEQ ID NOS:708 and 1169) can be used in the constructs of the invention.

Of particular use in many embodiments that have a Fab ABD to human PD-1 is the ABD of XENP28652 1C11[PD-1]_H3.328_L3.152 as depicted in FIG. 94AG, including SEQ ID NOS:719 and 1180. Thus, the six CDRs and/or the VH and VL domains from XENP28652 (SEQ ID NOS:719 and 1180) can be used in the constructs of the invention.

B. Fc Domains

The Fc domain component of the invention is as described herein, which generally contains skew variants and/or optional pI variants and/or ablation variants are outlined herein.

The Fc domains can be derived from IgG Fc domains, e.g., IgG1, IgG2, IgG3 or IgG4 Fc domains, with IgG1 Fc domains finding particular use in the invention. The following describes Fc domains that are useful for IL-15/IL-15Rα Fc fusion monomers and checkpoint antibody fragments of the bispecific heterodimer proteins of the present invention.

The carboxy-terminal portion of each chain defines a constant region primarily responsible for effector function Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

Thus, the present invention provides different antibody domains, e.g., different Fc domains. As described herein and known in the art, the heterodimeric proteins of the invention comprise different domains, which can be overlapping as well. These domains include, but are not limited to, the Fc domain, the CH1 domain, the CH2 domain, the CH3 domain, the hinge domain, and the heavy constant domain (CH1-hinge-Fc domain or CH1-hinge-CH2-CH3).

Thus, the "Fc domain" includes the —CH2-CH3 domain, and optionally a hinge domain, and can be from human IgG1, IgG2, IgG3 or IgG4. When from IgG1, the Fc domain can be a variant human IgG1 domain, for example including amino acid substitutions 427L/434S. Additionally, the variant IgG1 Fc domain can comprises ablation variants such as E233P/L234V/L235A/G236del/S267K substitutions.

In some of the embodiments herein, when a protein fragment, e.g., IL-15 or IL-15Rα is attached to an Fc domain, it is the C-terminus of the IL-15 or IL-15Rα construct that is attached to all or part of the hinge of the Fc domain; for example, it is generally attached to the sequence EPKS (SEQ ID NO: 1220) which is the beginning of the hinge. In other embodiments, when a protein fragment, e.g., IL-15 or IL-15Rα, is attached to an Fc domain, it is the C-terminus of the IL-15 or IL-15Rα construct that is attached to the CH1 domain of the Fc domain.

In some of the constructs and sequences outlined herein of an Fc domain protein, the C-terminus of the IL-15 or IL-15Rα protein fragment is attached to the N-terminus of a domain linker, the C-terminus of which is attached to the N-terminus of a constant Fc domain (N-IL-15 or IL-15Rα protein fragment-linker-Fc domain-C) although that can be switched (N-Fc domain-linker-IL-15 or IL-15Rα protein fragment-C). In other constructs and sequence outlined herein, C-terminus of a first protein fragment is attached to the N-terminus of a second protein fragment, optionally via a domain linker, the C-terminus of the second protein fragment is attached to the N-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 9. While any suitable linker can be used, many embodiments utilize a glycine-serine polymer, including for example (GS)n, (GSGGS)n (SEQ ID NO:1217), (GGGGS)n (SEQ ID NO:1218), and (GGGS)n (SEQ ID NO:1219), where n is an integer of at least one (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers.

In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIG. 21 and FIG. 64 are heterodimeric Fc fusion proteins, meaning that the protein has two associated Fc sequences self-assembled into a heterodimeric Fc domain and at least one protein fragment (e.g., 1, 2 or more protein fragments) as more fully described below. In some cases, a first protein fragment is linked to a first Fc sequence and a second protein fragment is linked to a second Fc sequence. In other cases, a first protein fragment is linked to a first Fc sequence, and the first protein fragment is non-covalently attached to a second protein fragment that is not linked to an Fc sequence. In some cases, the heterodimeric Fc fusion protein contains a first protein fragment linked to a second protein fragment which is linked a first Fc sequence, and a second Fc sequence that is not linked to either the first or second protein fragments.

Accordingly, in some embodiments the present invention provides heterodimeric Fc fusion proteins that rely on the use of two different heavy chain variant Fc sequences, that will self-assemble to form a heterodimeric Fc domain fusion polypeptide.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers.

There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes herein as "skew" variants (see discussion in WO2014/145806), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric antibodies; one relies on the use of pI variants, such that each monomer has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B change be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glycine to glutamic acid), changing a charged residue from positive or negative to the opposite charge (e.g. aspartic acid to lysine) or changing a charged residue to a neutral residue (e.g., loss of a charge; lysine to serine). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A–+B or wt A––B), or by increasing one region and decreasing the other region (A+–B– or A–B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. As shown herein, the separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. As is known in the art, different Fcs will have different starting pIs which are exploited in the present invention. In general, as outlined herein, the pIs are engineered to result in a total pI difference of each monomer of at least about 0.1 logs, with 0.2 to 0.5 being preferred as outlined herein.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Pat. No. 8,637,641 (incorporated by reference in its entirety), lowering the pI of antibody constant domains (including those found in antibodies and Fc fusions) can lead to longer serum retention in vivo. These pI variants for increased serum half-life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

C. Heterodimerization Variants

The present invention provides heterodimeric proteins, including heterodimeric Fc fusion proteins in a variety of formats, which utilize heterodimeric variants to allow for heterodimeric formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

D. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in in the FIG. 29 of US2016/0355608, all of which is hereby incorporated by reference in its entirety, as well as in FIGS. 1A-1E.

One mechanism is generally referred to in the art as "knobs and holes", referring to amino acid engineering that creates steric influences to favor heterodimeric formation and disfavor homodimeric formation can also optionally be used; this is sometimes referred to as "knobs and holes", as described in Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer corresponding sets) and C220E/P228E/368E paired with C220R/E224R/P228R/K409R.

Additional monomer A and monomer B variants that can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIGS. 4A-4C. Of particular use in many embodiments are the pairs of sets including, but not limited to, S364K/E357Q:L368D/K370S; L368D/K370S:S364K; L368E/K370S:S364K; T411E/K360E/Q362E:D401K; L368D/K370S:S364K/E357L, K370S:S364K/E357Q and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

E. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be done: one monomer may be wild type, or a variant that does not display a significantly different pI from wild-type, and the other can be either more basic or more acidic. Alternatively, each monomer is changed, one to more basic and one to more acidic.

Preferred combinations of pI variants are shown in FIG. 30 of US2016/0355608, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$. In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge domain of the Fc domain, including positions 221, 222, 223, 224, 225, 233, 234, 235 and 236. It should be noted that changes in 233-236 can be made to increase effector function (along with 327A) in the IgG2 backbone. Thus, pI mutations and particularly substitutions can be made in one or more of positions 221-225, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 274, 296, 300, 309, 320, 322, 326, 327, 334 and 339. Again, all possible combinations of these 10 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the mutations can be independently and optionally selected from position 355, 359, 362, 384, 389, 392, 397, 418, 419, 444 and 447. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447. Exemplary embodiments of pI variants are provided in the Figures including FIG. 5.

F. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significant affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

G. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US2014/0370013. As discussed herein, which monomer to engineer is generally decided by the inherent pI of each monomer.

H. pI Variants that Also Confer Better FcRn In Vivo Binding

In the case where the pI variant decreases the pI of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wild-type Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

Exemplary embodiments of pI variants are provided in the Figures including FIG. 5.

I. Additional Fc Variants for Additional Functionality

In addition to pI amino acid variants, there are a number of useful Fc amino acid modification that can be made for a variety of reasons, including, but not limited to, altering binding to one or more FcγR receptors, altered binding to FcRn receptors, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

J. FcγR Variants

Accordingly, there are a number of useful Fc substitutions that can be made to alter binding to one or more of the FcγR receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in Ser. No. 11/124,620 (particularly FIG. 41), Ser. Nos. 11/174,287, 11/396,495, 11/538,406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/ 330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, Ser. Nos. 11/124,620 and 14/578,305 are useful.

In addition, there are additional Fc substitutions that find use in increased binding to the FcRn receptor and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I or V/434S, 436V/428L and 259I/308F/428L.

K. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of bispecific immunomodulatory antibodies desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

L. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, are also independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411E/K360E/Q362E:D401K; L368D/K370S: S364K/E357L, K370S:S364K/E357Q, T366S/L368A/Y407V:T366W and T366S/L368A/Y407V/Y349C:T366W/S354C, optionally ablation variants, optionally charged domain linkers and the heavy chain comprises pI variants.

In some embodiments, the Fc domain comprising an amino acid substitution selected from the group consisting of: 236R, 239D, 239E, 243L, M252Y, V259I, 267D, 267E, 298A, V308F, 328F, 328R, 330L, 332D, 332E, M428L, N434A, N434S, 236R/328R, 239D/332E, M428L, 236R/328F, V259/V308F, 267E/328F, M428L/N434S, Y436I/M428L, Y436V/M428L, Y436I/N434S, Y436V/N434S, 239D/332E/330L, M252Y/S254T/T256E, V259I/V308F/M428L, E233P/L234V/L235A/G236del/S267K, G236R/L328R and PVA/S267K. In some cases, the Fc domain comprises the amino acid substitution 239D/332E. In other cases, the Fc domain comprises the amino acid substitution G236R/L328R or PVA/S267K.

In one embodiment, a particular combination of skew and pI variants that finds use in the present invention is T366S/L368A/Y407V:T366W (optionally including a bridging disulfide, T366S/L368A/Y407V/Y349C:T366W/S354C) with one monomer comprises Q295E/N384D/Q418E/N481D and the other a positively charged domain linker. As will be appreciated in the art, the "knobs in holes" variants do not change pI, and thus can be used on either monomer.

Useful pairs of Fc dimerization variant sets (including skew and pI variants) are provided in FIGS. 4A-4E. Additional pI variants are provided in FIG. 5. Useful ablation variants are provided in FIG. 6. Useful embodiments of the non-cytokine components of the PD-1-targeted IL-15/IL-15Rα-Fc fusion proteins of the present invention are provided in FIGS. 7A-7E and 8A-8F. In addition, useful IL-15/Rα-Fc format backbones based on human IgG1, without the IL-15 and IL-15Rα (sushi) domain sequences.

IV. Useful Formats of the Invention

As shown in FIGS. 65A-65K, there are a number of useful formats of the PD-1-targeted IL-15/IL-15Rα-Fc fusion proteins (also referred to as PD-1-targeted IL-15/IL-15Rα heterodimeric proteins or heterodimeric fusion proteins) of the invention. In general, the heterodimeric fusion proteins of the invention have three functional components: an IL-15/IL-15Rα(sushi) component, an anti-PD-1 component, and an Fc component, each of which can take different forms as outlined herein and each of which can be combined with the other components in any configuration.

The first and the second Fc domains of the Fc component can have a set of amino acid substitutions selected from the group consisting of a) S267K/L368D/K370S:S267K/LS364K/E357Q; b) S364K/E357Q:L368D/K370S; c) L368D/K370S:S364K; d) L368E/K370S:S364K; e) T411E/K360E/Q362E:D401K; f) L368D/K370S:S364K/E357L; and g) K370S:S364K/E357Q, according to EU numbering.

In some instances, the first and second Fc domains have the substitutions L368D/K370S:S364K/E357Q, respectively. In certain instances, the first and second Fc domains have the substitutions S364K/E357Q:L368D/K370S, respectively.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/

G236del/S267K/A327G and E233P/L234V/L235A/ G236del, according to EU numbering.

Optionally, the first and/or second Fc domains have M428L/N434S variants for half-life extension. In some embodiments, the first and/or second Fc domains have 428L/434S variants for half-life extension. In some embodiments, the first and the second Fc domains each have M428L/N434S variants.

A. scIL-15/RαxscFv

Figure 65A:
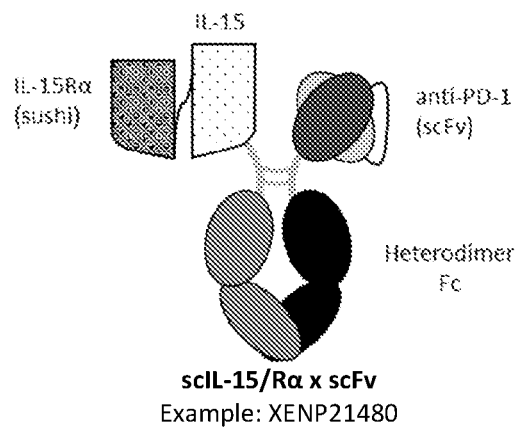

One embodiment is shown in FIG. 65A, and comprises two monomers. This is generally referred to as "scIL-15/ RαxscFv", with the "sc" standing for "single chain" referring to the attachment of the IL-15 and IL-15Rα sushi domain using a covalent linker. The "scIL-15/RαxscFv" format (see FIG. 65A) comprises a human IL-15Rα(sushi) domain fused to a human mature IL-15 by a variable length linker (termed "scIL-15/Rα") which is then fused to the N-terminus of a first Fc monomer, with an scFv fused to the N-terminus of a second Fc monomer. In some embodiments, the second Fc monomer comprises all or part of the hinge-CH2-CH3.

In some embodiments, the first monomer comprises, from N- to C-terminus, the human IL-15Rα sushi domain-domain linker-human IL-15-optional domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. Such combinations of Fc variants for this embodiment are found in FIGS. 8A and 8B.

As noted in FIGS. 93A-93S, FIGS. 94A-94AP, FIGS. 95A-95J, and FIGS. 96A-96F and is true for every sequence herein containing CDRs, the exact identification of the CDR locations may be slightly different depending on numbering used as is shown in Table 1, and thus included herein are not only the CDRs that are underlined but also CDRs included wherein the VH and VL domain using other numbering systems. Additionally, each CDR has its own SEQ ID NO: or sequence identifier, and each VH and VL domain has its own SEQ ID NO: or sequence identifier in the sequence listing.

In the scIL-15/RαxscFv format, one embodiment utilizes the anti-PD-1 ABD having the sequence 1G6_L1.194_H1.279 as shown in FIG. 66 including the sequence identifiers. Amino acid sequences of an illustrative PD-1-targeted IL-15/IL-15Rα-Fc fusion protein of the scIL-15/RαxscFv format such as XENP21480 is provided in FIG. 66. In the scIL-15/RαxscFv format, one embodiment utilizes the skew variant pair S364K/E357Q:L368D/K370S. In the scIL-15/RαxscFv format, one embodiment utilizes the anti-PD-1 ABD having the sequence 1G6_L1.194_H1.279 as shown in FIG. 66 and the skew variant pair S364K/ E357Q:L368D/K370S. In the scIL-15/RαxscFv format, one embodiment utilizes the anti-PD-1 ABD having the sequence 1G6_L1.194_H1.279 as shown in FIG. 66, in the FIG. 8A format: e.g., the skew variants S364K/E357Q (on the scFv-Fc monomer) and L368D/K370S (on the IL-15 complex monomer), the pI variants Q295E/N384D/Q418E/ N421D (on the IL-15 complex side), the ablation variants E233P/L234V/L235A/G236del/S267K on both monomers, and optionally the 428L/434S variants on both sides.

In the scIL-15/RαxscFv format, one embodiment utilizes the anti-PD-1 ABD having the variable heavy and variable light sequences from 1C11[PD-1]_H3L3 of XENP22538 as shown in FIG. 93A. In the scIL-15/RαxscFv format, one embodiment utilizes an anti-PD-1 ABD having the sequence 1C11[PD-1]_H3L3 of XENP22538 as shown in FIG. 93A in the FIG. 8A format. One embodiment utilizes an anti-PD-1 ABD having the sequence of a scFv variant of 1C11[PD-1]_ H3L3 as depicted in FIG. 93A-FIG. 93S, including the sequence identifiers. One embodiment utilizes an anti-PD-1 ABD having a variable heavy chain sequence of a variant of 1C11[PD-1]_H3L3 as depicted in FIG. 95A-FIG. 95J including the sequence identifiers and a variable light chain sequence of a variant of 1C11[PD-1]_H3L3 as depicted in FIG. 96A-FIG. 96F including the sequence identifiers. In some embodiments, an anti-PD-1 ABD of an scIL-15/Rα× scFv fusion protein comprises CDRs of the variable heavy chain sequence of a variant of 1C11[PD-1]_H3L3 depicted in FIG. 95A-FIG. 95J including the sequence identifiers and CDRs of the variable light chain sequence of a variant of 1C11[PD-1]_H3L3 depicted in FIG. 96A-FIG. 96F including the sequence identifiers.

In some embodiments of an scIL-15/RαxscFv fusion protein, the anti-PD-1 scFv utilizes the sequences of the ABD of any one of the XENP or corresponding SEQ ID NOS as depicted in FIGS. 93A-93S. In some instances, the anti-PD-1 scFv has a sequence of the ABD selected from the group consisting of XENP22538, XENP23577, XENP23579, XENP23589, XENP23601, XENP23605, XENP23609, XENP23615, XENP23616, XENP23624, XENP23626, XENP23628, XENP23629, XENP23633, XENP23636, XENP23640, XENP23755, XENP23758, XENP23760, XENP23765, XENP23770, XENP23776, XENP23779, XENP23780, XENP23781, XENP23789, XENP23793, XENP23796, XENP23811, XENP24201, XENP24207, XENP24208, XENP24209, XENP24210, XENP24211, XENP24212, XENP24213, XENP24214, XENP24215, XENP24216, XENP24217, XENP24218, XENP24221, XENP24222, XENP24226, XENP24227, XENP24228, XENP24247, XENP42450, XENP24254, XENP24256, XENP24263, XENP24266, XENP24267, XENP24268, XENP24270, XENP24274, XENP24278, XENP24279, XENP24287, XENP24291, XENP24372, XENP24373, XENP24374, XENP24375, XENP24376, XENP24377, XENP24378, XENP24379, XENP24380, XENP24381, XENP24382, XENP24414, XENP24415, XENP24416, XENP24417, XENP24418, XENP24419, XENP24420, XENP24421, XENP24422, XENP24423, XENP24424, XENP24425, XENP24426, XENP24427, XENP24428, XENP24429, XENP24430, XENP24431, XENP24432, XENP24433, XENP24434, XENP24435, XENP24436, XENP24437, XENP24438, XENP24439, XENP24440, XENP24441, XENP24442, XENP24443, XENP24827, XENP24828, XENP24829, XENP24830, XENP24831, XENP24832, XENP24833, XENP24834, XENP24835, XENP24836, XENP24837, XENP24838, XENP24839, XENP24840, XENP24841, XENP24842, XENP24843, XENP24844, XENP24845, XENP24846, XENP24847, XENP24848, XENP24849, XENP24850, XENP24851, XENP24852, XENP24853, XENP24854, XENP24855, XENP24856, XENP24857, XENP24858, XENP25295, XENP25296, XENP25301, XENP23502, XENP25303, XENP25304, XENP25305, XENP25306, XENP25307, XENP25308, XENP25309, XENP25310, XENP25311, XENP25312, XENP25313, XENP25314, XENP25315, XENP25316, XENP25317, XENP25318, XENP25319, XENP25320, XENP25321, XENP25802, XENP25803, XENP25804, XENP25805, XENP25806, XENP25807, XENP25808, XENP25809, XENP25810, XENP25811, XENP25812, XENP25813, XENP25814, XENP25815, XENP25816, XENP25817, XENP25818, and XENP25819, including the corresponding SEQ ID NOS.

In some embodiments, the scIL-15/RαxscFv format utilizes a scFv ABD to human PD-1 having the sequence of the ABD of XENP25806 or 1C11[PD-1]_H3.234_L3.144, as depicted in FIG. 93R including the SEQ ID NOS. In other words, the six CDRs and/or the VH and VL domains from XENP25806 can be used in an exemplary scIL-15/RαxantiPD-1 scFv format.

In certain embodiments, the scIL-15/RαxscFv format utilizes a scFv ABD to human PD-1 having the sequence of the ABD of XENP25812 or 1C11[PD-1]_H3.240_L3.148, as depicted in FIG. 93R including the SEQ ID NOS. In other words, the six CDRs and/or the VH and VL domains from XENP25812 can be used in an exemplary scIL-15/RαxantiPD-1 scFv format.

In particular embodiments, the scIL-15/RαxscFv format utilizes a scFv ABD to human PD-1 having the sequence of the ABD of XENP25813 or 1C11[PD-1]_H3.241_L3.148, as depicted in FIG. 93R including the SEQ ID NOS. In other words, the six CDRs and/or the VH and VL domains from XENP25813 can be used in an exemplary scIL-15/RαxantiPD-1 scFv format.

In other embodiments, the scIL-15/RαxscFv format utilizes a scFv ABD to human PD-1 having the sequence of the ABD of XENP25819 or 1C11[PD-1]_H3.241_L3.92, as depicted in FIG. 93S including the SEQ ID NOS. In other words, the six CDRs and/or the VH and VL domains from XENP25819 can be used in an exemplary scIL-15/RαxantiPD-1 scFv format.

In the scIL-15/RαxscFv format, a preferred embodiment utilizes the IL-15 complex (sushi domain-linker-IL-15) of chain 1 of XENP22022 as depicted in FIG. 69A including the SEQ ID NOS. In the scIL-15/RαxscFv format, one preferred embodiment utilizes the IL-15 complex (sushi domain-linker-IL-15 variant N4D/N65D) of chain 2 of XENP25850 as depicted in FIG. 69C. In the scIL-15/Rα scFv format, another preferred embodiment utilizes the IL-15 complex (sushi domain-linker-IL-15 variant D30N/N65D) of chain 1 of XENP29482 as depicted in FIG. 126A. In the scIL-15/RαxscFv format, another preferred embodiment utilizes the IL-15 complex (sushi domain-linker-IL-15 variant D30N/E64Q/N65D) of chain 1 of XENP29286 as depicted in FIG. 124C.

In the scIL-15/Rαxanti-PD-1 scFv format, one preferred embodiment utilizes the anti-PD-1 ABD having the sequence 1G6_L1.194_H1.279 as shown in FIG. 66 and the IL-15 complex (sushi domain-linker-IL-15) of chain 1 of XENP22022 as depicted in FIG. 69A. In some instances, the scIL-15/Rαxanti-PD-1 scFv Fc fusion protein contains an anti-PD-1 ABD having the sequence 1G6_L1.194_H1.279 as shown in FIG. 66 and an IL-15 complex (sushi domain-linker-IL-15 variant N4D/N65D) of chain 2 of XENP25850 as depicted in FIG. 69C. In other instances, the Fc fusion protein contains an anti-PD-1 ABD having the sequence 1G6_L1.194_H1.279 as shown in FIG. 66 and an IL-15 complex (sushi domain-linker-IL-15 variant D30N/N65D) of chain 1 of XENP29482 as depicted in FIG. 126A. In certain instances, the Fc fusion protein contains an anti-PD-1 ABD having the sequence 1G6_L1.194_H1.279 as shown in FIG. 66 and an IL-15 complex (sushi domain-linker-IL-15 variant D30N/E64Q/N65D) of XENP29286 as depicted in FIG. 124C.

In the scIL-15/Rαxanti-PD-1 scFv format, some embodiments include an anti-PD-1 ABD having the sequence 1C11[PD-1]_H3L3 of XENP22538 as shown in FIG. 93A and an IL-15 complex (sushi domain-linker-IL-15) of chain 1 of XENP22022 as depicted in FIG. 69A. In some embodiments, the scIL-15/Rαxanti-PD-1 scFv Fc fusion protein contains an anti-PD-1 ABD having the sequence 1C11[PD-1]_H3L3 of XENP22538 as shown in FIG. 93A and an IL-15 complex (sushi domain-linker-IL-15 variant N4D/N65D) of chain 2 of XENP25850 as depicted in FIG. 69C. In other embodiments, such Fc fusion proteins contain an anti-PD-1 ABD having the sequence 1C11[PD-1]_H3L3 of XENP22538 as shown in FIG. 93A and an IL-15 complex (sushi domain-linker-IL-15 variant D30N/N65D) of chain 1 of XENP29482 as depicted in FIG. 126A. In certain embodiments, such Fc fusion proteins contain an anti-PD-1 ABD having the sequence 1C11[PD-1]_H3L3 of XENP22538 as shown in FIG. 93A and an IL-15 complex (sushi domain-linker-IL-15 variant D30N/E64Q/N65D) of chain 1 of XENP29286 as depicted in FIG. 124C.

In the scIL-15/Rαxanti-PD-1 scFv format, some embodiments include an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F and the IL-15 complex (sushi domain-linker-IL-15) of chain 1 of XENP22022 as depicted in FIG. 69A. In some embodiments, the scIL-15/Rαxanti-PD-1 scFv Fc fusion protein contains an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F and the IL-15 complex (sushi domain-linker-IL-15 variant N4D/N65D) of chain 2 of XENP25850 as depicted in FIG. 69C. In other embodiments, such Fc fusion proteins contain an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F and the IL-15 complex (sushi domain-linker-IL-15 variant D30N/N65D) of chain 1 of XENP29482 as depicted in FIG. 126A. In some embodiments, such Fc fusion proteins contain an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F and the IL-15 complex (sushi domain-linker-IL-15 variant D30N/E64Q/N65D) of chain 1 of XENP29286 as depicted in FIG. 124C.

In the scIL-15/Rαxanti-PD-1 scFv format, some embodiments include an anti-PD-1 ABD having the sequence of XENP25806 or 1C11[PD-1]_H3.234_L3.144 as depicted in FIG. 93R and the IL-15 complex (sushi domain-linker-IL-15) of chain 1 of XENP22022 as depicted in FIG. 69A. In some embodiments, the scIL-15/Rαxanti-PD-1 scFv Fc fusion protein contains an anti-PD-1 ABD having the sequence of XENP25806 or 1C11[PD-1]_H3.234_L3.144 as depicted in FIG. 93R and an IL-15 complex (sushi domain-linker-IL-15 variant N4D/N65D) of chain 2 of XENP25850 as depicted in FIG. 69C. In some embodiments, such Fc fusion proteins contain an anti-PD-1 ABD having the sequence of XENP25806 or 1C11[PD-1]_H3.234_L3.144 as depicted in FIG. 93R and an IL-15 complex (sushi domain-linker-IL-15 variant D30N/N65D) of chain 1 of XENP29482 as depicted in FIG. 126A. In some embodiments, such Fc fusion proteins contain an anti-PD-1 ABD having the sequence of XENP25806 or 1C11[PD-1]_H3.234_L3.144 as depicted in FIG. 93R and the IL-15 complex (sushi domain-linker-IL-15 variant D30N/E64Q/N65D) of chain 1 of XENP29286 as depicted in FIG. 124C.

In the scIL-15/Rαxanti-PD-1 scFv format, some embodiments include an anti-PD-1 ABD having the sequence of XENP25812 or 1C11[PD-1]_H3.240_L3.148, as depicted in FIG. 93R and the IL-15 complex (sushi domain-linker-IL-15) of chain 1 of XENP22022 as depicted in FIG. 69A. In some embodiments, the scIL-15/Rα×anti-PD-1 scFv Fc fusion protein contains an anti-PD-1 ABD having the sequence of XENP25812 or 1C11[PD-1]_H3.240_L3.148, as depicted in FIG. 93R and an IL-15 complex (sushi domain-linker-IL-15 variant N4D/N65D) of chain 2 of XENP25850 as depicted in FIG. 69C. In some embodiments, such Fc fusion proteins contain an anti-PD-1 ABD having the sequence of XENP25812 or 1C11[PD-1]_H3.240_L3.148, as depicted in FIG. 93R and an IL-15 complex (sushi domain-linker-IL-15 variant D30N/N65D) of chain 1 of XENP29482 as depicted in FIG. 126A. In some embodiments, such Fc fusion proteins contain an anti-PD-1 ABD having the sequence of XENP25812 or 1C11[PD-1]_H3.240_L3.148, as depicted in FIG. 93R and an IL-15 complex (sushi domain-linker-IL-15 variant D30N/E64Q/N65D) of chain 1 of XENP29286 as depicted in FIG. 124C.

In the scIL-15/Rα×anti-PD-1 scFv format, some embodiments include an anti-PD-1 ABD having the sequence of XENP25813 or 1C11[PD-1]_H3.241_L3.148 as depicted in FIG. 93R and the IL-15 complex (sushi domain-linker-IL-15) of chain 1 of XENP22022 as depicted in FIG. 69A. In some embodiments, the scIL-15/Rα×anti-PD-1 scFv Fc fusion protein contains an anti-PD-1 ABD having the sequence of XENP25813 or 1C11[PD-1]_H3.241_L3.148 as depicted in FIG. 93R and an IL-15 complex (sushi domain-linker-IL-15 variant N4D/N65D) of chain 2 of XENP25850 as depicted in FIG. 69C. In some embodiments, such Fc fusion proteins contain an anti-PD-1 ABD having the sequence of XENP25813 or 1C11[PD-1]_H3.241_L3.148 as depicted in FIG. 93R and an IL-15 complex (sushi domain-linker-IL-15 variant D30N/N65D) of chain 1 of XENP29482 as depicted in FIG. 126A. In some embodiments, such Fc fusion proteins contain an anti-PD-1 ABD having the sequence of XENP25813 or 1C11[PD-1]_H3.241_L3.148 as depicted in FIG. 93R and an IL-15 complex (sushi domain-linker-IL-15 variant D30N/E64Q/N65D) of chain 1 of XENP29286 as depicted in FIG. 124C.

In the scIL-15/Rα×anti-PD-1 scFv format, some embodiments include an anti-PD-1 ABD having the sequence of XENP25819 or 1C11[PD-1]_H3.241_L3.92 as depicted in FIG. 93S and the IL-15 complex (sushi domain-linker-IL-15) of chain 1 of XENP22022 as depicted in FIG. 69A. In some embodiments, the scIL-15/Rα×anti-PD-1 scFv Fc fusion protein contains an anti-PD-1 ABD having the sequence XENP25819 or 1C11[PD-1]_H3.241_L3.92 as depicted in FIG. 93S and the IL-15 complex (sushi domain-linker-IL-15 variant N4D/N65D) of chain 2 of XENP25850 as depicted in FIG. 69C. In some embodiments, such Fc fusion proteins contain an anti-PD-1 ABD having the sequence XENP25819 or 1C11[PD-1]_H3.241_L3.92 as depicted in FIG. 93S and the IL-15 complex (sushi domain-linker-IL-15 variant D30N/N65D) of chain 1 of XENP29482 as depicted in FIG. 126A. In some embodiments, such Fc fusion proteins contain an anti-PD-1 ABD having the sequence XENP25819 or 1C11[PD-1]_H3.241_L3.92 as depicted in FIG. 93S and the IL-15 complex (sushi domain-linker-IL-15 variant D30N/E64Q/N65D) of chain 1 of XENP29286 as depicted in FIG. 124C.

In the scIL-15/Rα×anti-PD-1 scFv format, one preferred embodiment utilizes the anti-PD-1 ABD having the VH and VL sequences of XENP26940 or 1C11_H3.303_L3.152 as depicted in FIG. 94N and the IL-15 complex (sushi domain-linker-IL-15) of chain 1 of XENP22022 as depicted in FIG. 69A. In some embodiments, the scIL-15/Rα×scFv comprises anti-PD-1 ABD having the VH and VL sequences of XENP26940 or 1C11_H3.303_L3.152 as depicted in FIG. 94N and the IL-15 complex (sushi domain-linker-IL-15 variant N4D/N65D) of chain 2 of XENP25850 as depicted in FIG. 69C. In some embodiments, the scIL-15/Rα×scFv comprises anti-PD-1 ABD having the VH and VL sequences of XENP26940 or 1C11_H3.303_L3.152 as depicted in FIG. 94N and the IL-15 complex (sushi domain-linker-IL-15 variant D30N/N65D) of chain 1 of XENP29482 as depicted in FIG. 126A. In some embodiments, the scIL-15/Rα×scFv comprises anti-PD-1 ABD having the VH and VL sequences of XENP26940 or 1C11_H3.303_L3.152 as depicted in FIG. 94N and the IL-15 complex (sushi domain-linker-IL-15 variant D30N/E64Q/N65D) of chain 1 of XENP29286 as depicted in FIG. 124C.

In the scIL-15/Rα×anti-PD-1 scFv format, one preferred embodiment utilizes the anti-PD-1 ABD having the VH and VL sequences of XENP28026 or 1C11_H3.329_L3.220 as shown in FIG. 94AE and the IL-15 complex (sushi domain-linker-IL-15) of chain 1 of XENP22022 as depicted in FIG. 69A. In some embodiments, the scIL-15/Rα×scFv comprises anti-PD-1 ABD having the VH and VL sequences of XENP28026 or 1C11_H3.329_L3.220 as shown in FIG. 94AE and the IL-15 complex (sushi domain-linker-IL-15 variant N4D/N65D) of chain 2 of XENP25850 as depicted in FIG. 69C. In some embodiments, the scIL-15/Rα×scFv comprises anti-PD-1 ABD having the VH and VL sequences of XENP28026 or 1C11_H3.329_L3.220 as shown in FIG. 94AE and the IL-15 complex (sushi domain-linker-IL-15 variant D30N/N65D) of chain 1 of XENP29482 as depicted in FIG. 126A. In some embodiments, the scIL-15/Rα×scFv comprises anti-PD-1 ABD having the VH and VL sequences of XENP28026 or 1C11_H3.329_L3.220 as shown in FIG. 94AE and the IL-15 complex (sushi domain-linker-IL-15 variant D30N/E64Q/N65D) of chain 1 of XENP29286 as depicted in FIG. 124C.

In the scIL-15/Rα×scFv format, one preferred embodiment utilizes the anti-PD-1 ABD having the VH and VL sequences of XENP28652 or 1C11_H3.328_L3.152 as depicted in FIG. 94AG and the IL-15 complex (sushi domain-linker-IL-15) of chain 1 of XENP22022 as depicted in FIG. 69A. In some embodiments, the scIL-15/Rα×scFv comprises anti-PD-1 ABD having the VH and VL sequences of XENP28652 or 1C11_H3.328_L3.152 as depicted in FIG. 94AG and the IL-15 complex (sushi domain-linker-IL-15 variant N4D/N65D) of chain 2 of XENP25850 as depicted in FIG. 69C. In some embodiments, the scIL-15/Rα×scFv comprises anti-PD-1 ABD having the VH and VL sequences of XENP28652 or 1C11_H3.328_L3.152 as depicted in FIG. 94AG and the IL-15 complex (sushi domain-linker-IL-15 variant D30N/N65D) of chain 1 of XENP29482 as depicted in FIG. 126A. In some embodiments, the scIL-15/Rα×scFv comprises anti-PD-1 ABD having the VH and VL sequences of XENP28652 or 1C11_H3.328_L3.152 as depicted in FIG. 94AG and the IL-15 complex (sushi domain-linker-IL-15 variant D30N/E64Q/N65D) of chain 1 of XENP29286 as depicted in FIG. 124C.

B. scFv×ncIL-15/Rα

Figure 65B:
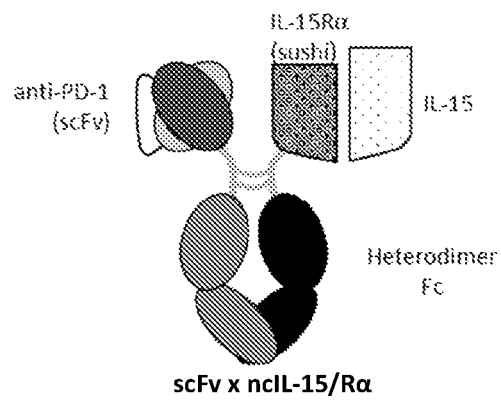

This embodiment is shown in FIG. 65B, and comprises three monomers. This is generally referred to as "ncIL-15/Rα×scFv" or "scFv×ncIL-15/Rα" with the "nc" standing for "non-covalent" referring to the self-assembling non-covalent attachment of the IL-15 and IL-15Rα sushi domain. The "scFv×ncIL-15/Rα" format (see FIG. 65B) comprises an scFv fused to the N-terminus of a first Fc monomer, with human IL-15Rα(sushi) fused to a second Fc monomer, while human mature IL-15 (such as a human mature IL-15 variant) is transfected separately so that a non-covalent IL-15/Rα complex is formed.

In some embodiments, the first monomer comprises, from N- to C-terminus, the sushi domain-domain linker-CH2-CH3, and the second monomer comprises vh-scFv linker-vl-hinge-CH2-CH3 or vl-scFv linker-vh-hinge-CH2-CH3, although in either orientation a domain linker can be substituted for the hinge. The third monomer is the mature IL-15 domain. Preferred combinations of variants for this embodiment are found in FIGS. 8A and 8B.

In the ncIL-15/RαxscFv format, one preferred embodiment utilizes the anti-PD-1 ABD having the sequence 1G6_L1.194_H1.279 as shown in FIG. 66. Amino acid sequences of an illustrative IL-15/Rαxanti-PD-1 heterodimeric protein of the scFvxncIL-15/Rα format is provided in FIG. 67. In some embodiments, the anti-PD-1 ABD has the sequence 1G6_L1.194_H1.279_scFv as shown in chain 1 of FIG. 67.

In the ncIL-15/RαxscFv format, one preferred embodiment utilizes the skew variant pair S364K/E357Q:L368D/K370S. In the ncIL-15/RαxscFv format, one preferred embodiment utilizes the anti-PD-1 ABD having the sequence 1G6_L1.194_H1.279 as shown in FIG. 66 and the skew variant pair S364K/E357Q:L368D/K370S. In the ncIL-15/RαxscFv format, one preferred embodiment utilizes the anti-PD-1 ABD having the sequence 1G6_L1.194_H1.279 as shown in FIG. 66, in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides. In the ncIL-15/RαxscFv format, one preferred embodiment utilizes the anti-PD-1 ABD having the sequence 1G6_L1.194_H1.279 as shown in FIG. 66, in the FIG. 8B format.

In the ncIL-15/RαxscFv format, one preferred embodiment utilizes the anti-PD-1 ABD having the variable heavy and variable light sequences from 1C11[PD-1]_H3L3 of XENP22538 as shown in FIG. 93A. In the ncIL-15/Rαx scFv format, one preferred embodiment utilizes the anti-PD-1 ABD having the sequence 1C11[PD-1]_H3L3 of XENP22538 as shown in FIG. 93A, in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides. In the ncIL-15/RαxscFv format, one preferred embodiment utilizes the anti-PD-1 ABD having the sequence 1C11[PD-1]_H3L3 of XENP22538 as shown in FIG. 93A in the FIG. 8B format. In the ncIL-15/RαxscFv format, one preferred embodiment utilizes the anti-PD-1 ABD having the sequence of a scFv variant of 1C11[PD-1]_H3L3 as depicted in FIG. 93A-FIG. 93S. In the ncIL-15/RαxscFv format, one preferred embodiment utilizes the anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F.

In some embodiments, the ncIL-15/RαxscFv format utilizes a scFv ABD to human PD-1 having the sequence of the ABD of XENP25806 or 1C11[PD-1]_H3.234_L3.144, as depicted in FIG. 93R. In other words, the six CDRs and/or the VH and VL domains from XENP25806 can be used in an exemplary ncIL-15/Rαxanti-PD-1 scFv format. In some embodiments, the ncIL-15/RαxscFv format utilizes a scFv ABD to human PD-1 having the sequence of the ABD of XENP25806 or 1C11[PD-1]_H3.234_L3.144, as depicted in FIG. 93R in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides.

In certain embodiments, the ncIL-15/RαxscFv format utilizes a scFv ABD to human PD-1 having the sequence of the ABD of XENP25812 or 1C11[PD-1]_H3.240_L3.148, as depicted in FIG. 93R. In other words, the six CDRs and/or the VH and VL domains from XENP25812 can be used in an exemplary ncIL-15/Rαxanti-PD-1 scFv format. In some embodiments, the ncIL-15/RαxscFv format utilizes a scFv ABD to human PD-1 having the sequence of the ABD of XENP25812 or 1C11[PD-1]_H3.240_L3.148, as depicted in FIG. 93R in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides.

In particular embodiments, the ncIL-15/RαxscFv format utilizes a scFv ABD to human PD-1 having the sequence of the ABD of XENP25813 or 1C11[PD-1]_H3.241_L3.148, as depicted in FIG. 93R. In other words, the six CDRs and/or the VH and VL domains from XENP25813 can be used in an exemplary ncIL-15/Rαxanti-PD-1 scFv format. In some embodiments, the ncIL-15/RαxscFv format utilizes a scFv ABD to human PD-1 having the sequence of the ABD of XENP25813 or 1C11[PD-1]_H3.241_L3.148, as depicted in FIG. 93R in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides.

In other embodiments, the ncIL-15/RαxscFv format utilizes a scFv ABD to human PD-1 having the sequence of the ABD of XENP25819 or 1C11[PD-1]_H3.241_L3.92, as depicted in FIG. 93S. In other words, the six CDRs and/or the VH and VL domains from XENP25819 can be used in an exemplary ncIL-15/Rαxanti-PD-1 scFv format. In some embodiments, the ncIL-15/RαxscFv format utilizes a scFv ABD to human PD-1 having the sequence of the ABD of XENP25819 or 1C11[PD-1]_H3.241_L3.92, as depicted in FIG. 93S in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides.

In some embodiments, the anti-PD-1 scFv of any of the ncIL-15/RαxscFv fusion protein outlined herein comprises the VH and VL sequences of XENP26940 or 1C11_H3.303_L3.152 as depicted in FIG. 94N, the VH and VL sequences of XENP28026 or 1C11_H3.329_L3.220 as shown in FIG. 94AE, or the VH and VL sequences of XENP28652 or 1C11_H3.328_L3.152 as depicted in FIG. 94AG.

In some embodiments, the ncIL-15/RαxscFv comprises a human IL-15Rα(sushi) domain and a human mature IL-15.

In certain embodiments, the ncIL-15/RαxscFv comprises a human IL-15Rα(sushi) domain and a human mature IL-15 variant having amino acid substitutions N4D/N65D. In particular embodiments, the ncIL-15/RαxscFv comprises a human IL-15Rα(sushi) domain and a human mature IL-15 variant having amino acid substitutions D30N/N65D. In certain embodiments, the ncIL-15/RαxscFv comprises a human IL-15Rα(sushi) domain and a human mature IL-15 variant having amino acid substitutions D30N/E64Q/N65D.

In the ncIL-15/RαxscFv format, one preferred embodiment utilizes the anti-PD-1 ABD having the variable heavy and variable light sequences from 1C11[PD-1]_H3L3 of XENP22538 as shown in FIG. 93A. In the ncIL-15/Rαx scFv format, one preferred embodiment utilizes the anti-PD-1 ABD having the sequence 1C11[PD-1]_H3L3 of XENP22538 as shown in FIG. 93A in the FIG. 8B format: e.g., the skew variants S364K/E357Q (on the IL-15Rα (sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides. In the ncIL-15/RαxscFv format, one preferred embodiment utilizes the anti-PD-1 ABD having the sequence 1C11[PD-1]_H3L3 of XENP22538 as shown in FIG. 93A in the FIG. 8B format. In the ncIL-15/RαxscFv format, one preferred embodiment utilizes the anti-PD-1 ABD having the sequence of a scFv variant of 1C11[PD-1]_H3L3 as depicted in FIG. 93A-FIG. 93S. In the ncIL-15/RαxscFv format, one preferred embodiment utilizes the anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F. In some embodiments, the ncIL-15/RαxscFv comprises a human IL-15Rα(sushi) domain and a human mature IL-15. In certain embodiments, the ncIL-15/RαxscFv comprises a human IL-15Rα(sushi) domain and a human mature IL-15 variant having amino acid substitutions N4D/N65D. In particular embodiments, the ncIL-15/RαxscFv comprises a human IL-15Rα(sushi) domain and a human mature IL-15 variant having amino acid substitutions D30N/N65D. In certain embodiments, the ncIL-15/RαxscFv comprises a human IL-15Rα(sushi) domain and a human mature IL-15 variant having amino acid substitutions D30N/E64Q/N65D.

In the ncIL-15/RαxscFv format, one preferred embodiment utilizes the anti-PD-1 ABD having the sequence of a scFv variant of 1C11[PD-1]_H3L3 as depicted in FIG. 93A-FIG. 93S, a human IL-15Rα(sushi) domain and a human mature IL-15 (such as a human mature IL-15 variant). In certain embodiments, the ncIL-15/RαxscFv comprises of a scFv variant of 1C11[PD-1]_H3L3 as depicted in FIG. 93A-FIG. 93S, a human IL-15Rα(sushi) domain and a human mature IL-15 variant having amino acid substitutions N4D/N65D. In particular embodiments, the ncIL-15/Rαx scFv comprises of a scFv variant of 1C11[PD-1]_H3L3 as depicted in FIG. 93A-FIG. 93S, a human IL-15Rα(sushi) domain and a human mature IL-15 variant having amino acid substitutions D30N/N65D. In certain embodiments, the ncIL-15/RαxscFv comprises of a scFv variant of 1C11[PD-1]_H3L3 as depicted in FIG. 93A-FIG. 93S, a human IL-15Rα(sushi) domain and a human mature IL-15 variant having amino acid substitutions D30N/E64Q/N65D.

In some embodiments, the ncIL-15/RαxscFv format utilizes a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 (such as a human mature IL-15 variant). In certain embodiments, the ncIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions N4D/N65D. In particular embodiments, the ncIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions D30N/N65D. In certain embodiments, the ncIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions D30N/E64Q/N65D.

In certain embodiments, the ncIL-15/RαxscFv format utilizes a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 (such as a human mature IL-15 variant). In certain embodiments, the ncIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions N4D/N65D. In particular embodiments, the ncIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions D30N/N65D. In certain embodiments, the ncIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions D30N/E64Q/N65D.

In particular embodiments, the ncIL-15/RαxscFv format utilizes a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 (such as a human mature IL-15 variant). In certain embodiments, the ncIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions N4D/N65D. In particular embodiments, the ncIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions D30N/N65D. In certain embodiments, the ncIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions D30N/E64Q/N65D.

In other embodiments, the ncIL-15/RαxscFv format utilizes a scFv ABD to human PD-1 having the sequence of the ABD of XENP25819 or 1C11[PD-1]_H3.241_L3.92, as depicted in FIG. 93S, a human IL-15Rα(sushi) domain and a human mature IL-15 (such as a human mature IL-15 variant). In certain embodiments, the ncIL-15/RαxscFv comprises a scFv ABD to human PD-1 having the sequence of the ABD of XENP25819 or 1C11[PD-1]_H3.241_L3.92, as depicted in FIG. 93S, a human IL-15Rα(sushi) domain and a human mature IL-15 variant having amino acid substitutions N4D/N65D. In particular embodiments, the ncIL-15/RαxscFv comprises a scFv ABD to human PD-1 having the sequence of the ABD of XENP25819 or 1C11 [PD-1]_H3.241_L3.92, as depicted in FIG. 93S, a human IL-15Rα(sushi) domain and a human mature IL-15 variant having amino acid substitutions D30N/N65D. In certain embodiments, the ncIL-15/RαxscFv comprises a scFv ABD to human PD-1 having the sequence of the ABD of XENP25819 or 1C11[PD-1]_H3.241_L3.92, as depicted in FIG. 93S, a human IL-15Rα(sushi) domain and a human mature IL-15 variant having amino acid substitutions D30N/ E64Q/N65D.

C. scFvxdsIL-15/Rα

Figure 65C:
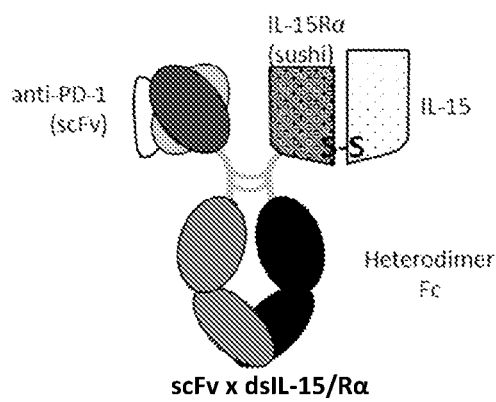

This embodiment is shown in FIG. 65C, and comprises three monomers. This is generally referred to as "scFvx dsIL-15/Rα" or dsIL-15/RαxscFv, with the "ds" standing for "disulfide". The "scFvxdsIL-15/Rα" format (FIG. 65C) is the same as the "scFvxncIL-15/Rα" format, but wherein IL-15Rα(sushi) and IL-15 are covalently linked as a result of engineered cysteines. The "scFvxdsIL-15/Rα" format comprises an scFv fused to the N-terminus of a first Fc monomer, with human IL-15Rα(sushi) fused to a second Fc monomer, while human mature IL-15 (such as a human mature IL-15 variant) is transfected separately so that a covalently linked IL-15/Rα complex is formed.

In some embodiments, the first monomer comprises, from N- to C-terminus, the sushi domain-domain linker-CH2-CH3, wherein the sushi domain has an engineered cysteine residue and the second monomer comprises vh-scFv linker-vl-hinge-CH2-CH3 or vl-scFv linker-vh-hinge-CH2-CH3, although in either orientation a domain linker can be substituted for the hinge. The third monomer is the IL-15 domain, also engineered to have a cysteine variant amino acid, thus allowing a disulfide bridge to form between the sushi domain and the IL-15 domain. Preferred combinations of variants for this embodiment are found in FIGS. 8A and 8B.

In the dsIL-15/RαxscFv format, one preferred embodiment utilizes the anti-PD-1 ABD having the sequence 1G6_L1.194_H1.279 as shown in FIG. 66. Amino acid sequences of an illustrative IL-15/Rαxanti-PD-1 heterodimeric protein of the "scFvxdsIL-15/Rα" format is provided in FIG. 68. In some embodiments, the anti-PD-1 ABD includes the sequence 1G6_L1.194_H1.279_scFv as shown in chain 1 of FIG. 66.

In the dsIL-15/RαxscFv format, one preferred embodiment utilizes the skew variant pair S364K/E357Q:L368D/K370S. In the dsIL-15/RαxscFv format, one preferred embodiment utilizes the skew variant pair S364K/E357Q: L368D/K370S and the anti-PD-1 ABD having the sequence 1G6_L1.194_H1.279 as shown in FIG. 66. In the dsIL-15/ RαxscFv format, one preferred embodiment utilizes the anti-PD-1 ABD having the sequence 1G6_L1.194_H1.279 as shown in FIG. 66, in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/ G236del/S267K on both monomers, and optionally the 428L/434S variants on both sides. In the dsIL-15/RαxscFv format, one preferred embodiment utilizes the anti-PD-1 ABD having the sequence 1G6_L1.194_H1.279 as shown in FIG. 66, in the FIG. 8B format.

In the dsIL-15/RαxscFv format, one preferred embodiment utilizes the anti-PD-1 ABD having the sequence 1C11 [PD-1]_H3L3 as shown in FIG. 93A. In the dsIL-15/Rαx scFv format, one preferred embodiment utilizes the anti-PD-1 ABD having the sequence 1C11[PD-1]_H3L3 as shown in FIG. 93A in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/ G236del/S267K on both monomers, and optionally the 428L/434S variants on both sides. In the dsIL-15/RαxscFv format, one preferred embodiment utilizes the anti-PD-1 ABD having the sequence 1C11[PD-1]_H3L3 as shown in FIG. 93A in the FIG. 8B format.

In the dsIL-15/RαxscFv format, one preferred embodiment utilizes the anti-PD-1 ABD having the variable heavy and variable light sequences from 1C11[PD-1]_H3L3 of XENP22538 as shown in FIG. 93A. In the dsIL-15/RαxscFv format, one preferred embodiment utilizes the anti-PD-1 ABD having the sequence 1C11[PD-1]_H3L3 of XENP22538 as shown in FIG. 93A in the FIG. 8B format: e.g., the skew variants S364K/E357Q (on the IL-15Rα (sushi)-Fc monomer) and L368D/K370S (on the scFv-Fc monomer), the pI variants Q295E/N384D/Q418E/N421D (on the scFv-Fc monomer), the ablation variants E233P/ L234V/L235A/G236del/S267K on both monomers, and optionally the 428L/434S variants on both sides. In the dsIL-15/RαxscFv format, one preferred embodiment utilizes the anti-PD-1 ABD having the sequence 1C11[PD-1]_ H3L3 of XENP22538 as shown in FIG. 93A in the FIG. 8B format. In the dsIL-15/RαxscFv format, one preferred embodiment utilizes the anti-PD-1 ABD having the sequence of a scFv variant of 1C11[PD-1]_H3L3 as depicted in FIG. 93A-FIG. 93S. In the dsIL-15/RαxscFv format, one preferred embodiment utilizes the anti-PD-1 ABD having a variable heavy chain sequence of a variant of 1C11[PD-1]_ H3L3 as depicted in FIG. 95A-FIG. 95J and a variable light chain sequence of a variant of 1C11[PD-1]_H3L3 as depicted in FIG. 96A-FIG. 96F.

In some embodiments, the dsIL-15/RαxscFv format utilizes a scFv ABD to human PD-1 having the sequence of the ABD of XENP25806 or 1C11[PD-1]_H3.234_L3.144, as depicted in FIG. 93R in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/ G236del/S267K on both monomers, and optionally the 428L/434S variants on both sides. In other words, the six CDRs and/or the VH and VL domains from XENP25806 can be used in an exemplary dsIL-15/Rαxanti-PD-1 scFv format.

In certain embodiments, the dsIL-15/RαxscFv format utilizes a scFv ABD to human PD-1 having the sequence of the ABD of XENP25812 or 1C11[PD-1]_H3.240_L3.148, as depicted in FIG. 93R. In other words, the six CDRs and/or the VH and VL domains from XENP25812 can be used in an exemplary dsIL-15/Rαxanti-PD-1 scFv format.

In particular embodiments, the dsIL-15/RαxscFv format utilizes a scFv ABD to human PD-1 having the sequence of the ABD of XENP25813 or 1C11[PD-1]_H3.241_L3.148, as depicted in FIG. 93R in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides. In other words, the six CDRs and/or the VH and VL domains from XENP25813 can be used in an exemplary dsIL-15/Rαxanti-PD-1 scFv format.

In other embodiments, the dsIL-15/RαxscFv format utilizes a scFv ABD to human PD-1 having the sequence of the ABD of XENP25819 or 1C11[PD-1]_H3.241_L3.92, as depicted in FIG. 93S in the FIG. 8B format: e.g., the skew variants S364K/E357Q (on the IL-15Rα(sushi)-Fc monomer) and L368D/K370S (on the scFv-Fc monomer), the pI variants Q295E/N384D/Q418E/N421D (on the scFv-Fc monomer), the ablation variants E233P/L234V/L235A/G236del/S267K on both monomers, and optionally the 428L/434S variants on both sides. In other words, the six CDRs and/or the VH and VL domains from XENP25819 can be used in an exemplary dsIL-15/Rαxanti-PD-1 scFv format.

In the dsIL-15/RαxscFv format, one preferred embodiment utilizes the anti-PD-1 ABD having the sequence of a scFv variant of 1C11[PD-1]_H3L3 as depicted in FIG. 93A-FIG. 93S, a human IL-15Rα(sushi) domain and a human mature IL-15 (such as a human mature IL-15 variant). In certain embodiments, the dsIL-15/RαxscFv comprises a scFv variant of 1C11[PD-1]_H3L3 as depicted in FIG. 93A-FIG. 93S, a human IL-15Rα(sushi) domain and a human mature IL-15 variant having amino acid substitutions N4D/N65D. In particular embodiments, the dsIL-15/Rα×scFv comprises a scFv variant of 1C11[PD-1]_H3L3 as depicted in FIG. 93A-FIG. 93S, a human IL-15Rα(sushi) domain and a human mature IL-15 variant having amino acid substitutions D30N/N65D. In certain embodiments, the dsIL-15/RαxscFv comprises a scFv variant of 1C11[PD-1]_H3L3 as depicted in FIG. 93A-FIG. 93S, a human IL-15Rα (sushi) domain and a human mature IL-15 variant having amino acid substitutions D30N/E64Q/N65D.

In the dsIL-15/RαxscFv format, one preferred embodiment utilizes the anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F, a human IL-15Rα(sushi) domain and a human mature IL-15 (such as a human mature IL-15 variant). In some embodiments, the dsIL-15/RαxscFv comprises an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F, a human IL-15Rα(sushi) domain, and a human mature IL-15 variant having amino acid substitutions N4D/N65D. In particular embodiments, the dsIL-15/RαxscFv comprises an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F, a human IL-15Rα(sushi) domain, and a human mature IL-15 variant having amino acid substitutions D30N/N65D. In certain embodiments, the dsIL-15/RαxscFv comprises an anti-PD-1 ABD having a variable heavy chain sequence of a variant of 1C11[PD-1]_H3L3 as depicted in FIG. 95A-FIG. 95J and a variable light chain sequence of a variant of 1C11[PD-1]_H3L3 as depicted in FIG. 96A-FIG. 96F, a human IL-15Rα(sushi) domain, and a human mature IL-15 variant having amino acid substitutions D30N/E64Q/N65D.

In some embodiments, the dsIL-15/RαxscFv format utilizes a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant. In certain embodiments, the dsIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions N4D/N65D. In particular embodiments, the dsIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions D30N/N65D. In certain embodiments, the dsIL-15/RαxscFv comprises a scFv ABD to human PD-1 having the sequence of the ABD of XENP25806 or 1C11[PD-1]_H3.234_L3.144 as depicted in FIG. 93R, a human IL-15Rα(sushi) domain and a human mature IL-15 variant having amino acid substitutions D30N/E64Q/N65D.

In certain embodiments, the dsIL-15/RαxscFv format utilizes a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant. In certain embodiments, the dsIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions N4D/N65D. In particular embodiments, the dsIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions D30N/N65D. In certain embodiments, the dsIL-15/RαxscFv comprises a scFv ABD to human PD-1 having the sequence of the ABD of XENP25812 or 1C11[PD-1]_H3.240_L3.148 as depicted in FIG. 93R, a human IL-15Rα(sushi) domain and a human mature IL-15 variant having amino acid substitutions D30N/E64Q/N65D.

In particular embodiments, the dsIL-15/RαxscFv format utilizes a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant. In certain embodiments, the dsIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions N4D/N65D. In particular embodiments, the dsIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions D30N/N65D. In certain embodiments, the dsIL-15/RαxscFv comprises a scFv ABD to human PD-1 having the sequence of the ABD of XENP25813 or 1C11[PD-1]_H3.241_L3.148 as depicted in FIG. 93R, a human IL-15Rα(sushi) domain and a human mature IL-15 variant having amino acid substitutions D30N/E64Q/N65D.

In other embodiments, the dsIL-15/RαxscFv format utilizes a scFv ABD to human PD-1 having the sequence of the ABD of XENP25819 or 1C11[PD-1]_H3.241_L3.92 as depicted in FIG. 93S, a human IL-15Rα(sushi) domain and a human mature IL-15 variant. In certain embodiments, the dsIL-15/RαxscFv comprises a scFv ABD to human PD-1 having the sequence of the ABD of XENP25819 or 1C11[PD-1]_H3.241_L3.92 as depicted in FIG. 93S, a human IL-15Rα(sushi) domain and a human mature IL-15 variant having amino acid substitutions N4D/N65D. In particular embodiments, the dsIL-15/RαxscFv comprises a scFv ABD to human PD-1 having the sequence of the ABD of XENP25819 or 1C11[PD-1]_H3.241_L3.92 as depicted in FIG. 93S, a human IL-15Rα(sushi) domain and a human mature IL-15 variant having amino acid substitutions D30N/N65D. In certain embodiments, the dsIL-15/RαxscFv comprises a scFv ABD to human PD-1 having the sequence of the ABD of XENP25819 or 1C11[PD-1]_H3.241_L3.92 as depicted in FIG. 93S, a human IL-15Rα(sushi) domain and a human mature IL-15 variant having amino acid substitutions D30N/E64Q/N65D.

In some embodiments, the anti-PD-1 scFv of any of the dsIL-15/RαxscFv fusion protein outlined herein comprises the VH and VL sequences of XENP26940 or 1C11_H3.303_L3.152 as depicted in FIG. 94N, the VH and VL sequences of XENP28026 or 1C11_H3.329_L3.220 as shown in FIG. 94AE, or the VH and VL sequences of XENP28652 or 1C11_H3.328_L3.152 as depicted in FIG. 94AG.

D. scIL-15/RαxFab

Figure 65D:
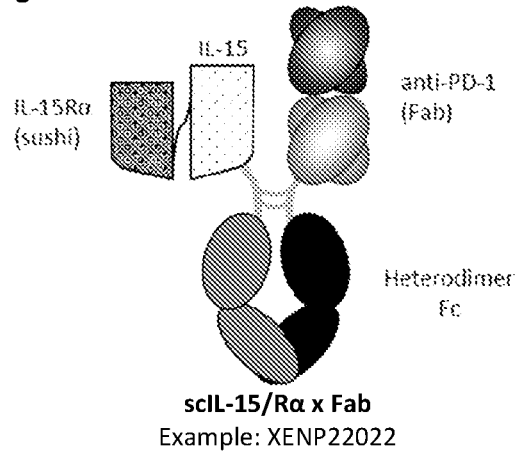

This embodiment is shown in FIG. 65D, and comprises three monomers. This is generally referred to as "scIL-15/RαxFab" or "FabxscIL-15/Rα," as used interchangeably, with the "sc" standing for "single chain". The "scIL-15/Rαx Fab" format (FIG. 65D) comprises IL-15Rα(sushi) fused to IL-15 by a variable length linker (termed "scIL-15/Rα") which is then fused to the N-terminus of a first Fc monomer, with a variable heavy chain (VH) fused to the other side of a second Fc monomer, while a corresponding light chain is transfected separately so as to form a Fab with the VH.

As noted in FIGS. 94A-94AP, FIGS. 95A-95J, FIGS. 96A-96F, FIGS. 126A-126D, FIGS. 127A-127D, and FIGS. 128A-128L and is true for every sequence herein containing CDRs, the exact identification of the CDR locations may be slightly different depending on numbering used as is shown in Table 1, and thus included herein are not only the CDRs that are bolded but also CDRs included wherein the VH and VL domain using other numbering systems. Additionally, each CDR has its own SEQ ID NO: or sequence identifier, and each VH and VL domain has its own SEQ ID NO: or sequence identifier in the sequence listing.

In some embodiments, the first monomer comprises, from N- to C-terminus, the human IL-15Rα sushi domain-domain linker-human mature IL-15-optional domain linker-CH2-CH3 and the second monomer comprises a heavy chain, VH-CH1-hinge-CH2-CH3. The third monomer is a light chain, VL-CL. Preferred combinations of Fc variants for this embodiment are found in FIG. 8C.

In some embodiments, the illustrative PD-1-targetedxIL-15/Rα-Fc fusion proteins of the scIL-15/RαxFab format comprises amino acid sequences of XENP22022, XENP25849, XENP24535, XENP24536, XENP25850, and XENP25937 are provided in FIGS. 69A-69C.

In some embodiments, the scIL-15/RαxFab comprises the skew variants S364K/E357Q (on the second monomer or heavy chain-Fc monomer) and L368D/K370S (on the first monomer or IL-15 complex-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides. In the scIL-15/RαxFab format, one preferred embodiment utilizes the skew variant pair S364K/E357Q:L368D/K370S.

In the scIL-15/RαxFab format, one preferred embodiment utilizes the anti-PD-1 ABD having the sequence 1G6_H1.279_L1.194 as shown in FIG. 14. In some embodiments, the anti-PD-1 ABD has CDRs and/or the VH and VL domains of 1G6_H1.279_L1.194. In the scIL-15/RαxFab format, one preferred embodiment utilizes the anti-PD-1 ABD having the sequence 1G6_H1.279_L1.194 as shown in FIG. 14, in the FIG. 8C format: e.g., the skew variants L368D/K370S (on the IL-15 complex Fc-monomer) and S364K/E357Q (on the heavy chain-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides. In the scIL-15/RαxFab format, one preferred embodiment utilizes the anti-PD-1 ABD having the sequence 1G6_H1.279_L1.194 as shown in FIG. 14 in the FIG. 8C format. In the scIL-15/RαxFab format, one preferred embodiment utilizes the anti-PD-1 ABD having the sequence 1G6_H1.279_L1.194 as shown in FIG. 14 and the skew variant pair S364K/E357Q:L368D/K370S.

In some embodiments, the anti-PD-1 Fab utilizes the sequences 1G6_H1.278 [PD-1] as shown in chain 2 of XENP22022 and 1G6_L1.188[PD-1] as shown in chain 3 of XENP22022 of FIG. 69A. In certain embodiments, the anti-PD-1 Fab utilizes the sequences 1C11[PD-1]_H3 as shown in chain 1 of XENP25849 and 1C11[PD-1]_L3 as shown in chain 3 of XENP25849 of FIG. 69A. In other embodiments, the anti-PD-1 Fab utilizes the sequences 1C11[PD-1]_H3 as shown in chain 1 of XENP24535 and 1C11[PD-1]_L3 as shown in chain 3 of XENP24535 of FIG. 69B. In some embodiments, the anti-PD-1 Fab utilizes the sequences 1C11[PD-1]_H3 as shown in chain 1 of XENP24536 and 1C11[PD-1]_L3 as shown in chain 3 of XENP24536 of FIG. 69B. In some embodiments, the anti-PD-1 Fab utilizes the sequences 1C11[PD-1]_H3L3 as shown in chain 1 of XENP25850 and 1C11[PD-1]_L3 as shown in chain 3 of XENP25850 of FIG. 69C. In certain embodiments, the anti-PD-1 Fab utilizes the sequences 1C11[PD-1]_H3 as shown in chain 1 of XENP259357 and 1C11[PD-1]_L3 as shown in chain 3 of XENP25937 of FIG. 69C. In some embodiments, the anti-PD-1 Fab utilizes the sequences of XENP22553 or 1C11_H3L3 as depicted in FIG. 94A. In some instances, the anti-PD-1 Fab utilizes the CDRs and/or the VH and VL domains from XENP22553 or 1C11_H3L3. In the scIL-15/RαxFab format, one preferred embodiment utilizes the anti-PD-1 ABD having the sequence 1C11[PD-1]_H3L3 as shown in FIG. 94. In the scIL-15/RαxFab format, one preferred embodiment utilizes the anti-PD-1 ABD having the sequence 1C11[PD-1]_H3L3 as shown in FIG. 94 in the FIG. 8C format: e.g., the skew variants L368D/K370S (on the IL-15 complex Fc-monomer) and S364K/E357Q (on the heavy chain-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides.

In some embodiments, the anti-PD-1 Fab utilizes the sequences of XENP26940 or 1C11_H3.303_L3.152 as depicted in FIG. 94N. In some instances, the anti-PD-1 Fab utilizes the CDRs and/or the VH and VL domains from XENP26940 or 1C11_H3.303_L3.152. In the scIL-15/Rαx Fab format, one preferred embodiment utilizes the anti-PD-1 ABD having the sequence of XENP26940 or 1C11_H3.303_L3.152. In the scIL-15/RαxFab format, one preferred embodiment utilizes the anti-PD-1 ABD having the sequence of XENP26940 or 1C11_H3.303_L3.152 as shown in FIG. 94N, in the FIG. 8C format: e.g., the skew variants L368D/K370S (on the IL-15 complex Fc-monomer) and S364K/E357Q (on the heavy chain-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides. In the scIL-15/RαxFab format, one preferred embodiment utilizes the anti-PD-1 ABD having the sequence of XENP26940 or 1C11_H3.303_L3.152 as shown in FIG. 94N in the FIG. 8C format. In the scIL-15/RαxFab format, one preferred embodiment utilizes the anti-PD-1 ABD having the sequence of XENP26940 or 1C11_H3.303_L3.152 as shown in FIG. 94N and the skew variant pair S364K/E357Q:L368D/K370S.

In some embodiments, the anti-PD-1 Fab utilizes the sequences of XENP28026 or 1C11_H3.329_L3.220 as depicted in FIG. 94AE. In some instances, the anti-PD-1 Fab utilizes the CDRs and/or the VH and VL domains from XENP28026 or 1C11_H3.329_L3.220. In the scIL-15/Rα Fab format, one preferred embodiment utilizes the anti-PD-1 ABD having the sequence of 1C11_H3.329_L3.220. In the scIL-15/RαxFab format, one preferred embodiment utilizes the anti-PD-1 ABD having the sequence of XENP28026 or 1C11_H3.329_L3.220 as shown in FIG. 94AE, in the FIG. 8C format: e.g., the skew variants L368D/K370S (on the IL-15 complex Fc-monomer) and S364K/E357Q (on the heavy chain-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides. In the scIL-15/RαxFab format, one preferred embodiment utilizes the anti-PD-1 ABD having the sequence of XENP28026 or 1C11_H3.329_L3.220 as shown in FIG. 94AE in the FIG. 8C format. In the scIL-15/RαxFab format, one preferred embodiment utilizes the anti-PD-1 ABD having the sequence of XENP28026 or 1C11_H3.329_L3.220 as shown in FIG. 94AE and the skew variant pair S364K/E357Q:L368D/K370S.

In some embodiments, the anti-PD-1 Fab utilizes the sequences of XENP28652 or 1C11_H3.328_L3.152 as depicted in FIG. 94AG. In some instances, the anti-PD-1 Fab utilizes the CDRs and/or the VH and VL domains from XENP28652 or 1C11_H3.328_L3.152. In the scIL-15/Rα Fab format, one preferred embodiment utilizes the anti-PD-1 ABD having the sequence of XENP28652 or 1C11_H3.328_L3.152. In the scIL-15/RαxFab format, one preferred embodiment utilizes the anti-PD-1 ABD having the sequence of XENP28652 or 1C11_H3.328_L3.152 as shown in FIG. 94AG, in the FIG. 8C format: e.g., the skew variants L368D/K370S (on the IL-15 complex Fc-monomer) and S364K/E357Q (on the heavy chain-Fc monomer), the pI variants Q295E/N384D/Q418E/N421D (on the IL-15 complex side), the ablation variants E233P/L234V/L235A/G236del/S267K on both monomers, and optionally the 428L/434S variants on both sides. In the scIL-15/RαxFab format, one preferred embodiment utilizes the anti-PD-1 ABD having the sequence of XENP28652 or 1C11_H3.328_L3.152 as shown in FIG. 94AG in the FIG. 8C format. In the scIL-15/RαxFab format, one preferred embodiment utilizes the anti-PD-1 ABD having the sequence of XENP28652 or 1C11_H3.328_L3.152 as shown in FIG. 94AG and the skew variant pair S364K/E357Q:L368D/K370S.

In one embodiment, the anti-PD-1 Fab utilizes the sequences of any one of the XENP or corresponding SEQ ID NO identifiers as depicted in FIGS. 94A-94AP. In some instances, the anti-PD-1 Fab has a sequence selected from the group consisting of XENP22553, XENP25338, XENP25339, XENP26321, XENP26322, XENP26323, XENP26324, XENP26325, XENP26326, XENP26327, XENP26328, XENP26329, XENP26330, XENP26331, XENP26332, XENP26333, XENP26334, XENP26335, XENP26336, XENP26337, XENP26338, XENP26339, XENP26340, XENP26341, XENP26342, XENP26343, XENP26344, XENP26917, XENP26918, XENP26919, XENP26920, XENP26921, XENP26922, XENP26923, XENP26924, XENP26925, XENP26926, XENP26927, XENP26928, XENP26929, XENP26930, XENP26931, XENP26932, XENP26933, XENP26934, XENP26935, XENP26936, XENP26937, XENP26938, XENP26939, XENP26940, XENP26941, XENP26942, XENP26943, XENP26944, XENP26945, XENP26946, XENP26947, XENP26949, XENP26950, XENP26951, XENP26952, XENP26953, XENP26954, XENP26955, XENP27643, XENP27644, XENP27645, XENP27646, XENP27647, XENP47648, XENP27649, XENP27650, XENP27651, XENP27652, XENP27839, XENP27840, XENP27841, XENP27842, XENP27843, XENP27844, XENP27845, XENP27846, XENP27847, XENP27848, XENP27849, XENP27850, XENP27851, XENP27852, XENP27853, XENP27854, XENP27855, XENP27856, XENP27857, XENP27858, XENP27859, XENP27860, XENP27861, XENP27862, XENP27863, XENP27864, XENP27865, XENP27866, XENP27867, XENP27868, XENP27869, XENP27870, XENP27871, XENP27872, XENP27959, XENP27960, XENP27961, XENP27962, XENP27963, XENP28024, XENP28025, XENP28026, XENP28027, XENP28028, XENP28029, XENP28030, XENP28031, XENP28032, XENP28033, XENP28034, XENP28035, XENP28651, XENP28652, XENP28653, XENP28654, XENP28655, XENP28656, XENP28657, XENP28658, XENP28659, XENP29029, XENP29030, XENP29031, XENP29032, XENP29033, XENP29034, XENP29035, XENP29036, XENP29037, XENP29038, XENP29039, XENP29040, XENP29041, XENP29042, XENP29043, XENP29044, XENP29045, XENP29046, XENP29047, XENP29048, XENP29049, XENP29050, XENP29051, XENP29052, XENP29053, XENP29054, XENP29055, and XENP29056, including the corresponding SEQ ID NO identifiers.

In another embodiment, the anti-PD-1 Fab utilizes the variable heavy chain sequence of any one of the XenD or corresponding SEQ ID NO identifier as depicted in FIGS. 95A-95J and the variable light chain sequence of any one of the XenD or corresponding SEQ ID NO identifier as depicted in FIGS. 96A-96F. In some cases, the sequence of the variable heavy chain is selected from the group consisting of XenD17478, XenD18576, XenD22097, XenD22098, XenD22099, XenD22100, XenD22101, XenD22102, XenD22103, XenD22104, XenD22105, XenD22106, XenD22107, XenD22108, XenD22109, XenD22110, XenD22111, XenD22112, XenD22113, XenD22114, XenD22115, XenD22116, XenD22117, XenD22118, XenD22119, XenD22120, XenD22121, XenD22122, XenD22123, XenD22124, XenD22125, XenD22126, XenD22127, XenD22128, XenD22129, XenD22130, XenD22131, XenD22132, XenD22133, XenD22134, XenD22135, XenD22136, XenD22137, XenD22138, XenD22139, XenD22140, XenD22141, XenD22142, XenD22143, XenD22144, XenD22145, XenD22146, XenD22147, XenD22148, XenD22149, XenD22150, XenD22150, XenD22152, XenD22153, XenD22154, XenD22155, XenD22156, XenD22157, XenD22158, XenD22159, XenD22160, XenD22161, and XenD22162, including the corresponding SEQ ID NO identifiers. In some cases, the sequence of the variable light chain is selected from the group consisting of XenD17482, XenD18472, XenD22163, XenD22164, XenD22165, XenD22166, XenD22167, XenD22168, XenD22169, XenD22170, XenD22157, XenD22158, XenD22159, XenD22161, XenD22162, XenD22171, XenD22172, XenD22173, XenD22174, XenD22175, XenD22176, XenD22177, XenD22178, XenD22179, XenD22180, XenD22181, XenD22182, XenD22183, XenD22184, XenD22185, XenD22186, XenD22184, XenD22185, XenD22186, XenD22187, XenD22188, XenD22189, XenD22190, XenD22191, XenD22192, XenD22193, XenD22194, XenD22195, XenD22196, XenD22197, XenD22198, XenD22199, XenD22200, XenD22201, XenD22202, XenD22203, XenD22204, XenD22205, XenD22206, XenD22207, XenD22208, XenD22209, XenD22210, XenD22211, XenD22212, XenD22213, XenD22214, XenD22215, XenD22216, XenD22217, XenD22218, XenD22219, XenD22220, XenD22221, XenD22222, and XenD22223 of FIG. 96, including the corresponding SEQ ID NO identifiers.

In the scIL-15/RαxFab format, one preferred embodiment utilizes the anti-PD-1 ABD having the sequence of 1G6_H1.279_L1.194 (1G6_L1.194_H1.279) as shown in FIG. 14 and the IL-15 complex (sushi domain-linker-IL-15) of chain 1 of XENP22022 as depicted in FIG. 69A. In some embodiments, the scIL-15/RαxFab comprises anti-PD-1 ABD having the sequence of 1G6_H1.279_L1.194 (1G6_L1.194_H1.279) as shown in FIG. 14 and the IL-15 complex (sushi domain-linker-IL-15 variant N4D/N65D) of chain 2 of XENP25850 as depicted in FIG. 69C. In some embodiments, the scIL-15/RαxFab comprises anti-PD-1 ABD having the sequence of 1G6_H1.279_L1.194 (1G6_L1.194_H1.279) as shown in FIG. 14 and the IL-15 complex (sushi domain-linker-IL-15 variant D30N/N65D) of chain 1 of XENP29482 as depicted in FIG. 126A. In some embodiments, the scIL-15/RαxFab comprises anti-PD-1 ABD having the sequence of 1G6_H1.279_L1.194 (1G6_L1.194_H1.279) as shown in FIG. 14 and the IL-15 complex (sushi domain-linker-IL-15 variant D30N/E64Q/N65D) of chain 1 of the constructs as depicted in FIG. 124C.

In the scIL-15/RαxFab format, one preferred embodiment utilizes the anti-PD-1 ABD having the sequence of 1C11_H3L3 as shown in FIG. 94A and the IL-15 complex (sushi domain-linker-IL-15) of chain 1 of XENP22022 as depicted in FIG. 69A. In some embodiments, the scIL-15/RαxFab comprises anti-PD-1 ABD having the sequence of 1C11_H3L3 as shown in FIG. 94A and the IL-15 complex (sushi domain-linker-IL-15 variant N4D/N65D) of chain 2 of XENP25850 as depicted in FIG. 69C. In some embodiments, the scIL-15/RαxFab comprises anti-PD-1 ABD having the sequence of 1C11_H3L3 as shown in FIG. 94A and the IL-15 complex (sushi domain-linker-IL-15 variant D30N/N65D) of chain 1 of XENP29482 as depicted in FIG. 126A. In some embodiments, the scIL-15/RαxFab comprises anti-PD-1 ABD having the sequence of 1C11_H3L3 as shown in FIG. 94A and the IL-15 complex (sushi domain-linker-IL-15 variant D30N/E64Q/N65D) of chain 1 of XENP29286 as depicted in FIG. 124C.

In the scIL-15/RαxFab format, one preferred embodiment utilizes the anti-PD-1 ABD having the sequence of XENP26940 or 1C11_H3.303_L3.152 as depicted in FIG. 94N and the IL-15 complex (sushi domain-linker-IL-15) of chain 1 of XENP22022 as depicted in FIG. 69A. In some embodiments, the scIL-15/RαxFab comprises anti-PD-1 ABD having the sequence of XENP26940 or 1C11_H3.303_L3.152 as depicted in FIG. 94N and the IL-15 complex (sushi domain-linker-IL-15 variant N4D/N65D) of chain 2 of XENP25850 as depicted in FIG. 69C. In some embodiments, the scIL-15/RαxFab comprises anti-PD-1 ABD having the sequence of XENP26940 or 1C11_H3.303_L3.152 as depicted in FIG. 94N and the IL-15 complex (sushi domain-linker-IL-15 variant D30N/N65D) of chain 1 of XENP29482 as depicted in FIG. 126A. In some embodiments, the scIL-15/RαxFab comprises anti-PD-1 ABD having the sequence of XENP26940 or 1C11_H3.303_L3.152 as depicted in FIG. 94N and the IL-15 complex (sushi domain-linker-IL-15 variant D30N/E64Q/N65D) of chain 1 of XENP29286 as depicted in FIG. 124C.

In the scIL-15/RαxFab format, one preferred embodiment utilizes the anti-PD-1 ABD having the sequence of XENP28026 or 1C11_H3.329_L3.220 as shown in FIG. 94AE and the IL-15 complex (sushi domain-linker-IL-15) of chain 1 of XENP22022 as depicted in FIG. 69A. In some embodiments, the scIL-15/RαxFab comprises anti-PD-1 ABD having the sequence of XENP28026 or 1C11_H3.329_L3.220 as shown in FIG. 94AE and the IL-15 complex (sushi domain-linker-IL-15 variant N4D/N65D) of chain 2 of XENP25850 as depicted in FIG. 69C. In some embodiments, the scIL-15/RαxFab comprises anti-PD-1 ABD having the sequence of XENP28026 or 1C11_H3.329_L3.220 as shown in FIG. 94AE and the IL-15 complex (sushi domain-linker-IL-15 variant D30N/N65D) of chain 1 of XENP29482 as depicted in FIG. 126A. In some embodiments, the scIL-15/RαxFab comprises anti-PD-1 ABD having the sequence of XENP28026 or 1C11_H3.329_L3.220 as shown in FIG. 94AE and the IL-15 complex (sushi domain-linker-IL-15 variant D30N/E64Q/N65D) of chain 1 of XENP29286 as depicted in FIG. 124C.

In the scIL-15/RαxFab format, one preferred embodiment utilizes the anti-PD-1 ABD having the sequence of XENP28652 or 1C11_H3.328_L3.152 as depicted in FIG. 94AG and the IL-15 complex (sushi domain-linker-IL-15) of chain 1 of XENP22022 as depicted in FIG. 69A. In some embodiments, the scIL-15/RαxFab comprises anti-PD-1 ABD having the sequence of XENP28652 or 1C11_H3.328_L3.152 as depicted in FIG. 94AG and the IL-15 complex (sushi domain-linker-IL-15 variant N4D/N65D) of chain 2 of XENP25850 as depicted in FIG. 69C. In some embodiments, the scIL-15/RαxFab comprises anti-PD-1 ABD having the sequence of XENP28652 or 1C11_H3.328_L3.152 as depicted in FIG. 94AG and the IL-15 complex (sushi domain-linker-IL-15 variant D30N/N65D) of chain 1 of XENP29482 as depicted in FIG. 126A. In some embodiments, the scIL-15/RαxFab comprises anti-PD-1 ABD having the sequence of XENP28652 or 1C11_H3.328_L3.152 as depicted in FIG. 94AG and the IL-15 complex (sushi domain-linker-IL-15 variant D30N/E64Q/N65D) of chain 1 of XENP29286 as depicted in FIG. 124C.

In some embodiments, the anti-PD-1 Fab of the scIL-15/RαxFab format has the heavy chain and light chain sequences of XENP25806 or 1C11[PD-1]_H3.234_L3.144, as depicted in FIG. 93R, the heavy chain and light chain sequences of the ABD of XENP25812 or 1C11[PD-1]_H3.240_L3.148, as depicted in FIG. 93R, the heavy chain and light chain sequences of XENP25813 or 1C11[PD-1]_H3.241_L3.148, as depicted in FIG. 93R, or the heavy chain and light chain sequences of XENP25819 or 1C11[PD-1]_H3.241_L3.92, as depicted in FIG. 93S.

E. ncIL-15/RαxFab

Figure 65E:
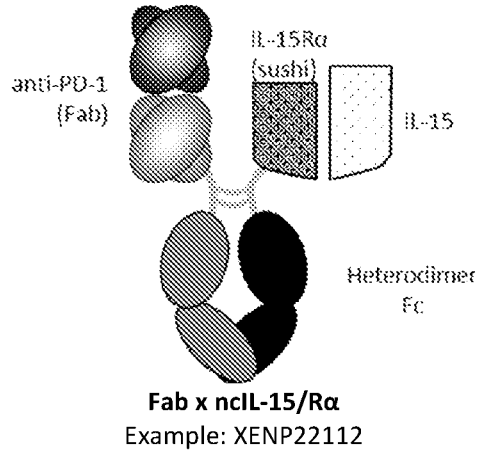

This embodiment is shown in FIG. 65E, and comprises three monomers. This is generally referred to as "ncIL-15/RαxFab" or "FabxncIL-15/Rα," as used interchangeably, with the "nc" standing for "non-covalent" referring to the self-assembling non-covalent attachment of the IL-15 and IL-15Rα sushi domain. The ncIL-15/RαxFab format (see FIG. 65E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. Amino acid sequences of an illustrative PD-1-targetedxIL-15/Rα-Fc fusion proteins of the FabxncIL-15/Rα format such as XENP22112 is provided in FIG. 70.

In some embodiments, the first monomer comprises, from N- to C-terminus, the IL-15Rα sushi domain-optional domain linker-CH2-CH3, and the second monomer comprises a heavy chain, VH-CH1-hinge-CH2-CH3. The third monomer is the IL-15 domain. Preferred combinations of Fc variants for this embodiment are found in FIG. 8D.

In the ncIL-15/RαxFab format, one preferred embodiment utilizes the skew variant pair S364K/E357Q:L368D/K370S. In the ncIL-15/RαxFab format, one preferred embodiment utilizes the anti-PD-1 ABD having the sequence 1G6_L1.194_H1.279 as shown in FIG. 14. In the ncIL-15/RαxFab format, one preferred embodiment utilizes the anti-PD-1 ABD having the sequence 1G6_L1.194_H1.279 (1G6_H1.279_L1.194) as shown in FIG. 14, in the FIG. 8D format: e.g., the skew variants L368D/K370S (on the heavy chain-Fc monomer) and S364K/E357Q (on the sushi domain-Fc-monomer), the pI variants Q295E/N384D/Q418E/N421D (on the heavy chain-Fc monomer), the ablation variants E233P/L234V/L235A/G236del/S267K on both monomers, and optionally the 428L/434S variants on both sides.

In the ncIL-15/RαxFab format, one preferred embodiment utilizes the anti-PD-1 ABD having the sequence 1C11[PD-1]_H3L3 as shown in FIG. 20C and the skew variant pair S364K/E357Q:L368D/K370S. In the ncIL-15/RαxFab format, one preferred embodiment utilizes the anti-PD-1 ABD having the sequence 1C11[PD-1]_H3L3 as shown in FIG. 20C in the FIG. 8D format: e.g., the skew variants L368D/K370S (on the heavy chain-Fc monomer) and S364K/E357Q (on the sushi domain-Fc-monomer), the pI variants Q295E/N384D/Q418E/N421D (on the heavy chain-Fc monomer), the ablation variants E233P/L234V/L235A/G236del/S267K on both monomers, and optionally the 428L/434S variants on both sides.

In some embodiments, ncIL-15/RαxFab of the invention comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, ncIL-15/RαxFab of the invention comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, ncIL-15/RαxFab comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, ncIL-15/RαxFab comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, ncIL-15/RαxFab of the invention comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, ncIL-15/RαxFab of the invention comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions N4D/N65D. In some embodiments, ncIL-15/RαxFab comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/N65D. In some embodiments, ncIL-15/RαxFab comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, ncIL-15/RαxFab of the invention comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, ncIL-15/RαxFab of the invention comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, ncIL-15/RαxFab comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, ncIL-15/RαxFab comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/E64Q/N65D.

In some embodiments, the anti-PD-1 Fab of the ncIL-15/RαxFab format has the heavy chain and light chain sequences of XENP25806 or 1C11[PD-1]_H3.234_L3.144, as depicted in FIG. 93R, the heavy chain and light chain sequences of the ABD of XENP25812 or 1C11[PD-1]_H3.240_L3.148, as depicted in FIG. 93R, the heavy chain and light chain sequences of XENP25813 or 1C11[PD-1]_H3.241_L3.148, as depicted in FIG. 93R, or the heavy chain and light chain sequences of XENP25819 or 1C11[PD-1]_H3.241_L3.92, as depicted in FIG. 93S.

F. dsIL-15/RαxFab

Figure 65F:
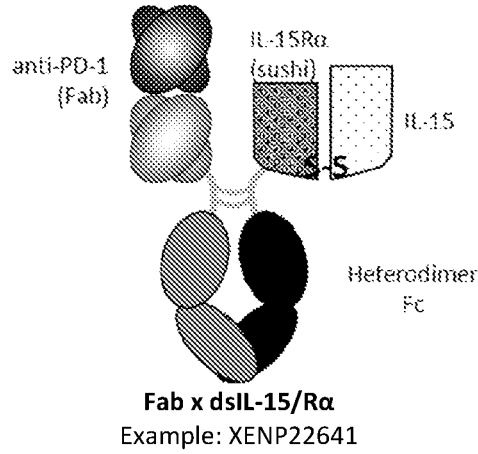

This embodiment is shown in FIG. 65F, and comprises three monomers. This is generally referred to as "dsIL-15/RαxFab" or "FabxdsIL-15/Rα," as used interchangeably, with the "ds" standing for "disulfide" referring to the self-assembling non-covalent attachment of the IL-15 and sushi domain. The dsIL-15/RαxFab format (see FIG. 65F) is the same as the "ncIL-15/RαxFab" format, but wherein IL-15Rα(sushi) and IL-15 are covalently linked as a result of engineered cysteines. Amino acid sequences of an illustrative PD-1-targetedxIL-15/Rα-Fc fusion protein of the FabxdsIL-15/Rα format such as XENP22641 is provided in FIG. 71.

In some embodiments, the first monomer comprises, from N- to C-terminus, the sushi domain-domain linker-CH2-CH3, wherein the sushi domain has been engineered to contain a cysteine residue, and the second monomer comprises a heavy chain, VH-CH1-hinge-CH2-CH3. The third monomer is the IL-15 domain, also engineered to have a cysteine residue, such that a disulfide bridge is formed under native cellular conditions. Preferred combinations of variants for this embodiment are found in FIG. 7 of WO2018/071918.

In the dsIL-15/RαxFab format, one preferred embodiment utilizes the skew variant pair S364K/E357Q:L368D/K370S. In the dsIL-15/RαxFab format, one preferred embodiment utilizes the anti-PD-1 ABD having the sequence 1G6_L1.194_H1.279 as shown in FIG. 14. In the dsIL-15/RαxFab format, one preferred embodiment utilizes the anti-PD-1 ABD having the sequence 1G6_L1.194_H1.279 (1G6_H1.279_L1.194) as shown in FIG. 14, in the FIG. 8D format: e.g., the skew variants L368D/K370S (on the heavy chain-Fc monomer) and S364K/E357Q (on the IL-15 complex Fc-monomer), the pI variants Q295E/N384D/Q418E/N421D (on the heavy chain-Fc monomer), the ablation variants E233P/L234V/L235A/G236del/S267K on both monomers, and optionally the 428L/434S variants on both sides.

In the dsIL-15/RαxFab format, one preferred embodiment utilizes the anti-PD-1 ABD having the sequence 1C11[PD-1]_H3L3 as shown in FIG. 20C and the skew variant pair S364K/E357Q:L368D/K370S. In the dsIL-15/RαxFab format, one preferred embodiment utilizes the anti-PD-1 ABD having the sequence 1C11[PD-1]_H3L3 as shown in FIG. 20C in the FIG. 8D format.

In some embodiments, dsIL-15/RαxFab of the invention comprises an anti-PD-1 ABD having the sequence of XENP26940 or 1C11_H3.303_L3.152 as shown in FIG. 94N. In some embodiments, dsIL-15/RαxFab of the invention comprises an anti-PD-1 ABD having the sequence of XENP28026 or 1C11_H3.329_L3.220 as shown in FIG. 94AE. In some embodiments, dsIL-15/RαxFab of the invention comprises an anti-PD-1 ABD having the sequence of XENP28652 or 1C11_H3.328_L3.152 as shown in FIG. 94AG.

In some embodiments, dsIL-15/RαxFab of the invention comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, dsIL-15/RαxFab of the invention comprises an anti-PD-1 ABD having the sequence o of XENP26940 or 1C11_H3.303_L3.152 as shown in FIG. 94N, a human IL-15 Rα(sushi) domain, and a human mature IL-15 variant having amino acid substitutions N4D/N65D. In some embodiments, dsIL-15/RαxFab comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, dsIL-15/RαxFab comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, dsIL-15/RαxFab of the invention comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, dsIL-15/RαxFab of the invention comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions N4D/N65D. In some embodiments, dsIL-15/RαxFab comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/N65D. In some embodiments, dsIL-15/RαxFab comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, dsIL-15/RαxFab of the invention comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, dsIL-15/RαxFab of the invention comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, dsIL-15/RαxFab comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, dsIL-15/RαxFab comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/E64Q/N65D.

In some embodiments, the anti-PD-1 Fab of the dsIL-15/RαxFab format has the heavy chain and light chain sequences of XENP25806 or 1C11[PD-1]_H3.234_L3.144, as depicted in FIG. 93R, the heavy chain and light chain sequences of the ABD of XENP25812 or 1C11[PD-1]_H3.240_L3.148, as depicted in FIG. 93R, the heavy chain and light chain sequences of XENP25813 or 1C11[PD-1]_H3.241_L3.148, as depicted in FIG. 93R, or the heavy chain and light chain sequences of XENP25819 or 1C11[PD-1]_H3.241_L3.92, as depicted in FIG. 93S.

G. mAb-scIL-15/Rα

Figure 65G:
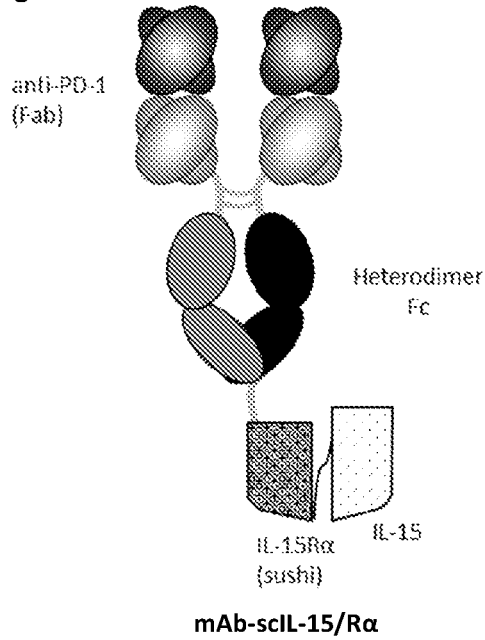

This embodiment is shown in FIG. 65G, and comprises three monomers (although the fusion protein is a tetramer). This is generally referred to as "mAb-scIL-15/Rα", with the "sc" standing for "single chain". The mAb-scIL-15/Rα format (see FIG. 65G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form Fabs with the VHs. Amino acid sequences of illustrative PD-1-targetedxIL-15/Rα-Fc fusion protein of the mAbxscIL-15/Rα format are provided in FIGS. 72A-72B.

In some embodiments, the first monomer comprises a heavy chain, VH-CH1-hinge-CH2-CH3. The second monomer comprises a heavy chain with a scIL-15 complex, VH-CH1-hinge-CH2-CH3-domain linker-IL-15Rα sushi domain-domain linker-IL-15. The third (and fourth) monomer are light chains, VL-CL. This is generally referred to as "mAb-scIL-15/Rα", with the "sc" standing for "single chain".

In the mAb-scIL-15/Rα format, one preferred embodiment utilizes the anti-PD-1 ABD having the sequence 1G6_L1.194_H1.279 as shown in FIG. 14. In the mAb-scIL-15/Rα format, one preferred embodiment utilizes the skew variant pair S364K/E357Q:L368D/K370S. In the mAb-scIL-15/Rα format, one preferred embodiment utilizes the anti-PD-1 ABD having the sequence 1G6_L1.194_H1.279 as shown in FIG. 14, in a useful format of FIGS. 8A-8F.

In the mAb-scIL-15/Rα format, one preferred embodiment utilizes the anti-PD-1 ABD having the sequence 1C11 [PD-1]_H3L3 as shown in FIG. 20C.

In the mAb-scIL-15/Rα format, one preferred embodiment utilizes the anti-PD-1 ABD having the sequence 1C11 [PD-1]_H3L3 as shown in FIG. 20C and the skew variant pair S364K/E357Q:L368D/K370S. In the mAb-scIL-15/Rα format, one preferred embodiment utilizes the anti-PD-1 ABD having the sequence 1C11[PD-1]_H3L3 as shown in FIG. 20C in a useful format of FIGS. 8A-8F.

In some embodiments, the mAb-scIL-15/Rα comprises any of the anti-PD-1 ABDs described herein. In some embodiments, the mAb-scIL-15/Rα comprises an anti-PD-1 ABD comprising: heavy chain and light chain sequences of XENP25806 or 1C11[PD-1]_H3.234_L3.144, as depicted in FIG. 93R, heavy chain and light chain sequences of the ABD of XENP25812 or 1C11[PD-1]_H3.240_L3.148, as depicted in FIG. 93R, heavy chain and light chain sequences of XENP25813 or 1C11[PD-1]_H3.241_L3.148, as depicted in FIG. 93R, or heavy chain and light chain sequences of XENP25819 or 1C11[PD-1]_H3.241_L3.92, as depicted in FIG. 93S. In some embodiments, the mAb-scIL-15/Rα of the invention comprises an anti-PD-1 ABD having the sequence of XENP26940 or 1C11_H3.303_L3.152 as shown in FIG. 94N. In some embodiments, the mAb-scIL-15/Rα comprises an anti-PD-1 ABD having the sequence of XENP28026 or 1C11_H3.329_L3.220 as shown in FIG. 94AE. In some embodiments, the mAb-scIL-15/Rα comprises an anti-PD-1 ABD having the sequence of XENP28652 or 1C11_H3.328_L3.152 as shown in FIG. 94AG.

In the mAb-scIL-15/Rα format, one preferred embodiment utilizes any of the IL-15 complex sequences described herein. In some embodiments, the IL-15 complex comprises from N- to C-terminus: a human IL-15 Rα sushi domain, a domain linker, and a human mature IL-15 domain (such as a human mature IL-15 variant). In some embodiments, the IL-15 complex comprises from N- to C-terminus: a human IL-15 Rα sushi domain, a domain linker, and a human mature IL-15 variant having amino acid substitutions N4D/N65D. In some embodiments, the IL-15 complex comprises from N- to C-terminus: a human IL-15 Rα sushi domain, a domain linker, and a human mature IL-15 variant having amino acid substitutions D30N/N65D. In some embodiments, the IL-15 complex comprises from N- to C-terminus: a human IL-15 Rα sushi domain, a domain linker, and a human mature IL-15 variant having amino acid substitutions D30N/E64Q/N65D.

In the mAb-scIL-15/Rα format, one preferred embodiment utilizes the anti-PD-1 ABD having the sequence of 1C11_H3L3 as shown in FIG. 94A and the IL-15 complex (sushi domain-linker-IL-15) such as in chain 1 of XENP22022 as depicted in FIG. 69A. In some embodiments, the mAb-scIL-15/Rα comprises anti-PD-1 ABD having the sequence of 1C11_H3L3 as shown in FIG. 94A and the IL-15 complex (sushi domain-linker-IL-15 variant N4D/N65D) such as in chain 2 of XENP25850 as depicted in FIG. 69C. In some embodiments, the mAb-scIL-15/Rα comprises anti-PD-1 ABD having the sequence of 1C11_H3L3 as shown in FIG. 94A and the IL-15 complex (sushi domain-linker-IL-15 variant D30N/N65D) such as in chain 1 of XENP29482 as depicted in FIG. 126A. In some embodiments, the mAb-scIL-15/Rα comprises anti-PD-1 ABD having the sequence of 1C11_H3L3 as shown in FIG. 94A and the IL-15 complex (sushi domain-linker-IL-15 variant D30N/E64Q/N65D) such as in chain 1 of XENP29286 as depicted in FIG. 124C.

In some embodiments, the mAb-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, the mAb-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, the mAb-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, the mAb-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, the mAb-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, the mAb-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions N4D/N65D. In some embodiments, the mAb-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/N65D. In some embodiments, the mAb-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, the mAb-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, the mAb-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, the mAb-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, the mAb-scIL-15/Rα comprises an anti-PD-1 ABD having the sequence of XENP28652 or 1C11_H3.328_L3.152 as shown in FIG.

94AG, a human IL-15 Rα(sushi) domain, and a human mature IL-15 variant having amino acid substitutions D30N/E64Q/N65D.

H. mAb-ncIL-15/Rα

Figure 65H:
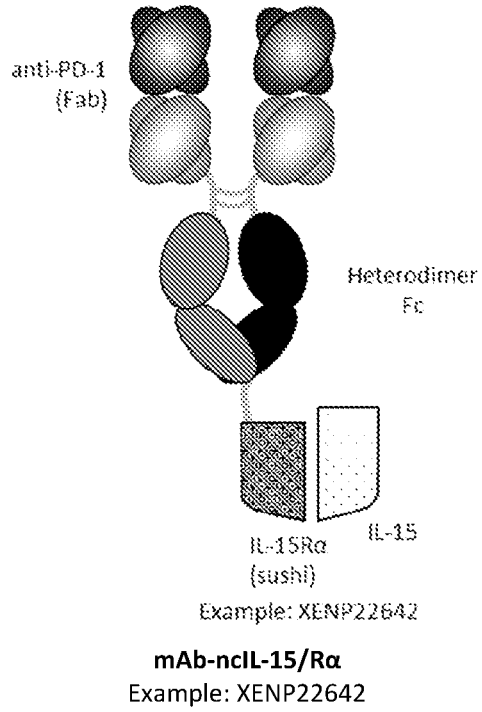

This embodiment is shown in FIG. 65H, and comprises four monomers (although the heterodimeric fusion protein is a pentamer). This is generally referred to as "mAb-ncIL-15/Rα", with the "nc" standing for "non-covalent". The mAb-ncIL-15/Rα format (FIG. 65H) comprises VH fused to the N-terminus of a first and a second heterodimeric Fc, with IL-15Rα(sushi) fused to the C-terminus of one of the heterodimeric Fc-region, while corresponding light chains are transfected separately so as to form Fabs with the VHs, and while IL-15 is transfected separately so that a non-covalent IL-15/Rα complex is formed. Amino acid sequences of illustrative IL-15/Rα×anti-PD-1 heterodimeric proteins of the mAb×ncIL-15/Rα format such as XENP22642 and XENP22643 are provided in FIGS. 73A-73B.

In some embodiments, the first monomer comprises a heavy chain, VH-CH1-hinge-CH2-CH3. The second monomer comprises a heavy chain with an IL-15Rα(sushi) domain, VH-CH1-hinge-CH2-CH3-domain linker-sushi domain. The third monomer is an IL-15 domain. The fourth (and fifth) monomer are light chains, VL-CL. Preferred combinations of Fc variants for this embodiment are found in FIGS. 8A-8F.

In the mAb-ncIL-15/Rα format, one preferred embodiment utilizes the anti-PD-1 ABD having the sequence 1G6_L1.194_H1.279 as shown in FIG. 14. In the mAb-ncIL-15/Rα format, one preferred embodiment utilizes the skew variant pair S364K/E357Q:L368D/K370S. In the mAb-ncIL-15/Rα format, one preferred embodiment utilizes the anti-PD-1 ABD having the sequence 1G6_L1.194_H1.279 as shown in FIG. 14, in a useful format of FIGS. 8A-8F.

In the mAb-ncIL-15/Rα format, one preferred embodiment utilizes the anti-PD-1 ABD having the sequence 1C11 [PD-1]_H3L3 as shown in FIG. 20C.

In the mAb-ncIL-15/Rα format, one preferred embodiment utilizes the anti-PD-1 ABD having the sequence 1C11 [PD-1]_H3L3 as shown in FIG. 20C and the skew variant pair S364K/E357Q:L368D/K370S. In the mAb-ncIL-15/Rα format, one preferred embodiment utilizes the anti-PD-1 ABD having the sequence 1C11[PD-1]_H3L3 as shown in FIG. 20C in a useful format of FIGS. 8A-8F.

In some embodiments, the mAb-ncIL-15/Rα comprises any of the anti-PD-1 ABDs described herein. In some embodiments, the mAb-ncIL-15/Rα comprises an anti-PD-1 ABD comprising: heavy chain and light chain sequences of XENP25806 or 1C11[PD-1]_H3.234_L3.144, as depicted in FIG. 93R, heavy chain and light chain sequences of the ABD of XENP25812 or 1C11[PD-1]_H3.240_L3.148, as depicted in FIG. 93R, heavy chain and light chain sequences of XENP25813 or 1C11[PD-1]_H3.241_L3.148, as depicted in FIG. 93R, or heavy chain and light chain sequences of XENP25819 or 1C11[PD-1]_H3.241_L3.92, as depicted in FIG. 93S. In some embodiments, mAb-ncIL-15/Rα of the invention comprises an anti-PD-1 ABD having the sequence of XENP26940 or 1C11_H3.303_L3.152 as shown in FIG. 94N. In some embodiments, the mAb-ncIL-15/Rα comprises an anti-PD-1 ABD having the sequence of XENP28026 or 1C11_H3.329_L3.220 as shown in FIG. 94AE. In some embodiments, the mAb-ncIL-15/Rα comprises an anti-PD-1 ABD having the sequence XENP28652 or 1C11_H3.328_L3.152 as shown in FIG. 94AG.

In the mAb-ncIL-15/Rα format, one preferred embodiment utilizes any of the IL-15 complex sequences described herein.

In the mAb-ncIL-15/Rα format, one preferred embodiment utilizes any of the IL-15 complex sequences described herein. In some embodiments, the IL-15 complex comprises a human IL-15 Rα sushi domain and a human mature IL-15 domain (such as a human mature IL-15 variant). In some embodiments, the IL-15 complex comprises a human IL-15 Rα sushi domain and a human mature IL-15 variant having amino acid substitutions N4D/N65D. In some embodiments, the IL-15 complex comprises a human IL-15 Rα sushi domain and a human mature IL-15 variant having amino acid substitutions D30N/N65D. In some embodiments, the IL-15 complex comprises a human IL-15 Rα sushi domain and a human mature IL-15 variant having amino acid substitutions D30N/E64Q/N65D.

In some embodiments, the mAb-ncIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, the mAb-ncIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, the mAb-ncIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, the mAb-ncIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, the mAb-ncIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, the mAb-ncIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions N4D/N65D. In some embodiments, the mAb-ncIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/N65D. In some embodiments, the mAb-ncIL-15/Rα comprises an anti-PD-1 ABD having the sequence o of XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, the mAb-ncIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, the mAb-ncIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, the mAb-ncIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/ N65D. In some embodiments, the mAb-ncIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/ E64Q/N65D.

I. mAb-dsIL-15/Rα

Figure 65I:
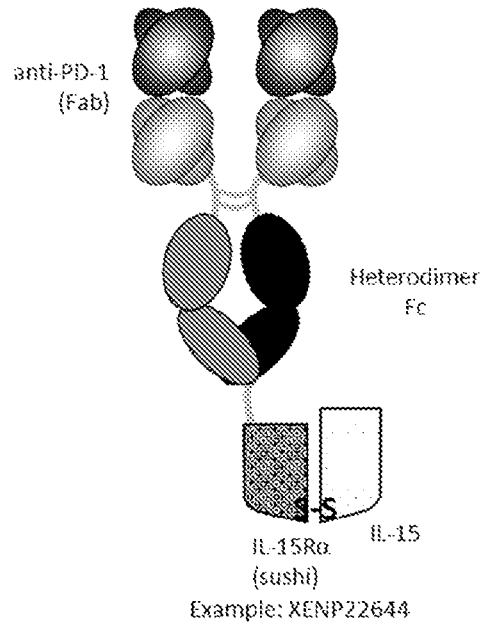

This embodiment is shown in FIG. 65I, and comprises four monomers (although the heterodimeric fusion protein is a pentamer). This is generally referred to as "mAb-ncIL-15/ Rα", with the "nc" standing for "non-covalent". The mAb-ncIL-15/Rα format (see FIG. 65H) comprises VH fused to the N-terminus of a first and a second heterodimeric Fc, with IL-15Rα(sushi) fused to the C-terminus of one of the heterodimeric Fc-region, while corresponding light chains are transfected separately so as to form a Fabs with the VHs, and while and while IL-15 is transfected separately so that a non-covalent IL-15/Rα complex is formed. Amino acid sequences of illustrative IL-15/Rα×anti-PD-1 heterodimeric proteins of the mAb×dsIL-15/Rα format such as XENP22644 and XENP22645 are provided in FIGS. 74A-74B.

In some embodiments, the anti-PD-1 ABD includes the sequence Nivolumab_H0 as shown in chain 2 and chain 3 of FIGS. 74A and 74B. In some embodiments, the anti-PD-1 ABD includes the sequence Nivolumab_L0 as shown in chain 4 of FIGS. 74A and 74B.

The first monomer comprises a heavy chain, VH-CH1-hinge-CH2-CH3. The second monomer comprises a heavy chain with an IL-15Rα(sushi) domain: VH-CH1-hinge-CH2-CH3-domain linker-sushi domain, where the sushi domain has been engineered to contain a cysteine residue. The third monomer is an IL-15 domain, which has been engineered to contain a cysteine residue, such that the IL-15 complex is formed under physiological conditions. The fourth (and fifth) monomer are light chains, VL-CL. Useful combinations of Fc variants for this embodiment are found in FIGS. 8A-8F.

In the mAb-dsIL-15/Rα format, one preferred embodiment utilizes the anti-PD-1 ABD having the sequence 1G6_L1.194_H1.279 as shown in FIG. 14.

In the mAb-dsIL-15/Rα format, one preferred embodiment utilizes the skew variant pair S364K/E357Q:L368D/ K370S. In some embodiments, the mAb-dsIL-15/Rα comprises an anti-PD-1 ABD having the sequence 1G6_L1.194_H1.279 as shown in FIG. 14 and the skew variant pair S364K/E357Q:L368D/K370S. In some embodiments, the mAb-dsIL-15/Rα comprises an anti-PD-1 ABD having the sequence 1G6_L1.194_H1.279 as shown in FIG. 14, in a useful format of FIGS. 8A-8F.

In the mAb-dsIL-15/Rα format, one preferred embodiment utilizes the anti-PD-1 ABD having the sequence 1C11 [PD-1]_H3L3 as shown in FIG. 20C.

In some embodiments, the mAb-dsIL-15/Rα comprises the skew variant pair S364K/E357Q:L368D/K370S. In some embodiments, the mAb-dsIL-15/Rα comprises the anti-PD-1 ABD having the sequence 1C11[PD-1]_H3L3 as shown in FIG. 20C and the skew variant pair S364K/E357Q: L368D/K370S. In the mAb-dsIL-15/Rα format, one preferred embodiment utilizes the anti-PD-1 ABD having the sequence 1C11[PD-1]_H3L3 as shown in FIG. 20C, in a useful format of FIGS. 8A-8F.

In some embodiments, the mAb-dsIL-15/Rα comprises any of the anti-PD-1 ABDs described herein. In some embodiments, the mAb-dsIL-15/Rα comprises an anti-PD-1 ABD comprising: heavy chain and light chain sequences of XENP25806 or 1C11[PD-1]_H3.234_L3.144, as depicted in FIG. 93R, heavy chain and light chain sequences of the ABD of XENP25812 or 1C11[PD-1]_H3.240_L3.148, as depicted in FIG. 93R, heavy chain and light chain sequences of XENP25813 or 1C11[PD-1]_H3.241_L3.148, as depicted in FIG. 93R, or heavy chain and light chain sequences of XENP25819 or 1C11[PD-1]_H3.241_L3.92, as depicted in FIG. 93S. In some embodiments, mAb-dsIL-15/Rα of the invention comprises an anti-PD-1 ABD having the sequence of XENP26940 or 1C11_H3.303_L3.152 as shown in FIG. 94N. In some embodiments, the mAb-dsIL-15/Rα comprises an anti-PD-1 ABD having the sequence of XENP28026 or 1C11_H3.329_L3.220 as shown in FIG. 94AE. In some embodiments, the mAb-dsIL-15/Rα comprises an anti-PD-1 ABD having the sequence of XENP28652 or 1C11_H3.328_L3.152 as shown in FIG. 94AG.

In the mAb-dsIL-15/Rα format, one preferred embodiment utilizes any of the IL-15 complex sequences described herein. In the mAb-dsIL-15/Rα format, one preferred embodiment utilizes any of the IL-15 complex sequences described herein. In some embodiments, the IL-15 complex comprises a human IL-15 Rα sushi domain and a human mature IL-15 domain (such as a human mature IL-15 variant). In some embodiments, the IL-15 complex comprises a human IL-15 Rα sushi domain and a human mature IL-15 variant having amino acid substitutions N4D/N65D. In some embodiments, the IL-15 complex comprises a human IL-15 Rα sushi domain and a human mature IL-15 variant having amino acid substitutions D30N/N65D. In some embodiments, the IL-15 complex comprises a human IL-15 Rα sushi domain and a human mature IL-15 variant having amino acid substitutions D30N/E64Q/N65D.

In some embodiments, the mAb-dsIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, the mAb-dsIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, the mAb-dsIL-15/ Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, the mAb-dsIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, the mAb-dsIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, the mAb-dsIL-15/Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions N4D/N65D. In some embodiments, the mAb-dsIL-15/ Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions D30N/N65D. In some embodiments, the mAb-dsIL-15/Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, the mAb-dsIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, the mAb-dsIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, the mAb-dsIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, the mAb-dsIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/E64Q/N65D.

J. Central-IL-15/Rα

Figure 65J:
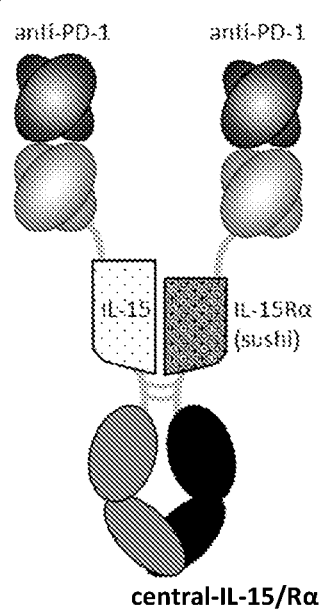
Figure 65K:
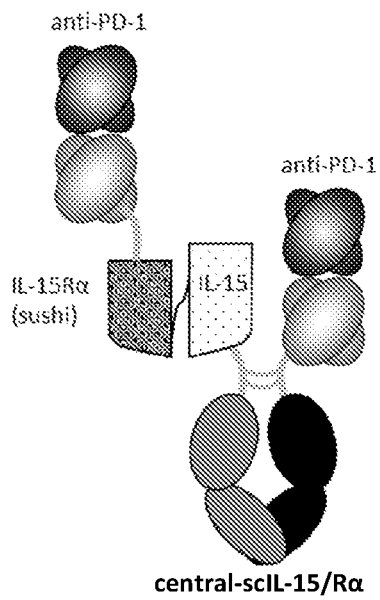

This embodiment is shown in FIG. 65J, and comprises four monomers forming a tetramer. This is generally referred to as "Central-IL-15/Rα". The central-IL-15/Rα format (see FIG. 65J) comprises a VH recombinantly fused to the N-terminus of IL-15 which is then further fused to one side of a heterodimeric Fc and a VH recombinantly fused to the N-terminus of IL-15Rα(sushi) which is then further fused to the other side of the heterodimeric Fc, while corresponding light chains are transfected separately so as to form a Fabs with the VHs. Amino acid sequences of illustrative IL-15/Rαxanti-PD-1 heterodimeric proteins of the central-IL-15/Rα format are provided in FIG. 75.

In some embodiments, the anti-PD-1 ABD includes the sequence 1C11[PD-1]_H3 as shown in chain 1 and chain 2 of FIG. 75. In some embodiments, the anti-PD-1 ABD includes the sequence 1C11[PD-1]_L3 as shown in chain 3 of FIG. 75.

In the central-IL-15/Rα format, one preferred embodiment utilizes the anti-PD-1 ABD having the sequence 1G6_L1.194_H1.279 as shown in FIG. 14.

In the central-IL-15/Rα format, one preferred embodiment utilizes the skew variant pair S364K/E357Q:L368D/K370S. In some embodiments, the central-IL-15/Rα comprises an anti-PD-1 ABD having the sequence 1G6_L1.194_H1.279 as shown in FIG. 14 and the skew variant pair S364K/E357Q:L368D/K370S. In some embodiments, the mAb-dsIL-15/Rα comprises an anti-PD-1 ABD having the sequence 1G6_L1.194_H1.279 as shown in FIG. 14, in a useful format of FIGS. 8A-8F.

In the central-IL-15/Rα format, one preferred embodiment utilizes the anti-PD-1 ABD having the sequence 1C11[PD-1]_H3L3 as shown in FIG. 20C.

In the central-IL-15/Rα format, the central-IL-15/Rα comprises the skew variant pair S364K/E357Q:L368D/K370S. In some embodiments, the central-IL-15/Rα comprises the anti-PD-1 ABD having the sequence 1C11[PD-1]_H3L3 as shown in FIG. 20C and the skew variant pair S364K/E357Q:L368D/K370S. In the central-IL-15/Rα format, one preferred embodiment utilizes the anti-PD-1 ABD having the sequence 1C11[PD-1]_H3L3 as shown in FIG. 20C, in a useful format of FIGS. 8A-8F.

In some embodiments, the central-IL-15/Rα comprises any of the anti-PD-1 ABDs described herein. In some embodiments, the central-IL-15/Rα comprises an anti-PD-1 ABD comprising: heavy chain and light chain sequences of XENP25806 or 1C11[PD-1]_H3.234_L3.144, as depicted in FIG. 93R, heavy chain and light chain sequences of the ABD of XENP25812 or 1C11[PD-1]_H3.240_L3.148, as depicted in FIG. 93R, heavy chain and light chain sequences of XENP25813 or 1C11[PD-1]_H3.241_L3.148, as depicted in FIG. 93R, or heavy chain and light chain sequences of XENP25819 or 1C11[PD-1]_H3.241_L3.92, as depicted in FIG. 93S. In some embodiments, central-IL-15/Rα comprises an anti-PD-1 ABD having the sequence of XENP26940 or 1C11_H3.303_L3.152 as shown in FIG. 94N. In some embodiments, the central-IL-15/Rα comprises an anti-PD-1 ABD having the sequence of XENP28026 or 1C11_H3.329_L3.220 as shown in FIG. 94AE. In some embodiments, the central-IL-15/Rα comprises an anti-PD-1 ABD having the sequence of XENP28652 or 1C11_H3.328_L3.152 as shown in FIG. 94AG.

In the central-IL-15/Rα format, one preferred embodiment utilizes any of the IL-15 complex sequences described herein. In the central-IL-15/Rα format, one preferred embodiment utilizes any of the IL-15 complex sequences described herein. In some embodiments, the IL-15 complex comprises a human IL-15 Rα sushi domain and a human mature IL-15 domain (such as a human mature IL-15 variant). In some embodiments, the IL-15 complex comprises a human IL-15 Rα sushi domain and a human mature IL-15 variant having amino acid substitutions N4D/N65D. In some embodiments, the IL-15 complex comprises a human IL-15 Rα sushi domain and a human mature IL-15 variant having amino acid substitutions D30N/N65D. In some embodiments, the IL-15 complex comprises a human IL-15 Rα sushi domain and a human mature IL-15 variant having amino acid substitutions D30N/E64Q/N65D.

In some embodiments, the central-IL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, the central-IL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, the central-IL-15/Rα comprises an anti-PD-1 ABD having the sequence of XENP26940 or 1C11_H3.303_L3.152 as shown in FIG. 94N, a human mature IL-15 variant having amino acid substitutions D30N/N65D. In some embodiments, the central-IL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, the central-IL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, the central-IL-15/Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions N4D/N65D. In some embodiments, the central-IL-15/

Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions D30N/N65D. In some embodiments, the central-IL-15/Rα comprises an anti-PD-1 ABD having the sequence XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, the central-IL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, the central-IL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, the central-IL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, the central-IL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/E64Q/N65D.

K. Central scIL-15/Rα

This embodiment is shown in FIG. 64K, and comprises four monomers forming a tetramer. This is generally referred to as "central-scIL-15/Rα", with the "sc" standing for "single chain". The central-scIL-15/Rα format (see FIG. 65K) comprises a VH fused to the N-terminus of IL-15Rα (sushi) which is fused to IL-15 which is then further fused to one side of a heterodimeric Fc and a VH fused to the other side of the heterodimeric Fc, while corresponding light chains are transfected separately so as to form a Fabs with the VHs. Amino acid sequences of illustrative IL-15/Rαx anti-PD-1 heterodimeric proteins of the central-scIL-15/Rα format are provided in FIG. 76.

In some embodiments, the anti-PD-1 ABD includes the sequence 1C11[PD-1]_H3 as shown in chain 1 and chain 2 of FIG. 76. In some embodiments, the anti-PD-1 ABD includes the sequence 1C11[PD-1]_L3 as shown in chain 3 of FIG. 76.

The first monomer comprises a VH-CH1-[optional domain linker]-sushi domain-domain linker-IL-15-[optional domain linker]-CH2-CH3, with the second optional domain linker sometimes being the hinge domain. The second monomer comprises a VH-CH1-hinge-CH2-CH3. The third (and fourth) monomers are light chains, VL-CL. Preferred combinations of variants for this embodiment are found in FIGS. 8A-8F.

In the central-scIL-15/Rα format, one preferred embodiment utilizes the anti-PD-1 ABD having the sequence 1G6_L1.194_H1.279 as shown in FIG. 14.

In the central-scIL-15/Rα format, one preferred embodiment utilizes the skew variant pair S364K/E357Q:L368D/K370S. In some embodiments, the central-scIL-15/Rα comprises an anti-PD-1 ABD having the sequence 1G6_L1.194_H1.279 as shown in FIG. 14 and the skew variant pair S364K/E357Q:L368D/K370S. In some embodiments, the central-scIL-15/Rα comprises an anti-PD-1 ABD having the sequence 1G6_L1.194_H1.279 as shown in FIG. 14, in a useful format of FIGS. 8A-8F.

In the central-scIL-15/Rα format, one preferred embodiment utilizes the anti-PD-1 ABD having the sequence 1C11[PD-1]_H3L3 as shown in FIG. 20C.

In some embodiments, the central-scIL-15/Rα comprises the skew variant pair S364K/E357Q:L368D/K370S. In some embodiments, the central-scIL-15/Rα comprises the anti-PD-1 ABD having the sequence 1C11[PD-1]_H3L3 as shown in FIG. 20C and the skew variant pair S364K/E357Q:L368D/K370S. In the central-scIL-15/Rα format, one preferred embodiment utilizes the anti-PD-1 ABD having the sequence 1C11[PD-1]_H3L3 as shown in FIG. 20C, in a useful format of FIGS. 8A-8F.

In some embodiments, the central-scIL-15/Rα comprises any of the anti-PD-1 ABDs described herein. In some embodiments, the central-scIL-15/Rα comprises an anti-PD-1 ABD comprising: heavy chain and light chain sequences of XENP25806 or 1C11[PD-1]_H3.234_L3.144, as depicted in FIG. 93R, heavy chain and light chain sequences of the ABD of XENP25812 or 1C11[PD-1]_H3.240_L3.148, as depicted in FIG. 93R, heavy chain and light chain sequences of XENP25813 or 1C11[PD-1]_H3.241_L3.148, as depicted in FIG. 93R, or heavy chain and light chain sequences of XENP25819 or 1C11[PD-1]_H3.241_L3.92, as depicted in FIG. 93S. n some embodiments, central-scIL-15/Rα comprises an anti-PD-1 ABD having the sequence of XENP26940 or 1C11_H3.303_L3.152 as shown in FIG. 94N. In some embodiments, the central-scIL-15/Rα comprises an anti-PD-1 ABD having the sequence of XENP28026 or 1C11_H3.329_L3.220 as shown in FIG. 94AE. In some embodiments, the central-scIL-15/Rα comprises an anti-PD-1 ABD having the sequence of XENP28652 or 1C11_H3.328_L3.152 as shown in FIG. 94AG.

In the central-scIL-15/Rα format, one preferred embodiment utilizes any of the IL-15 complex sequences described herein. In some embodiments, the IL-15 complex comprises from N- to C-terminus: a human IL-15Rα sushi domain, a domain linker, and a human mature IL-15 domain (such as a human mature IL-15 variant). In some embodiments, the IL-15 complex comprises from N- to C-terminus: a human IL-15 Rα sushi domain, a domain linker, and a human mature IL-15 variant having amino acid substitutions N4D/N65D. In some embodiments, the IL-15 complex comprises from N- to C-terminus: a human IL-15 Rα sushi domain, a domain linker, and a human mature IL-15 variant having amino acid substitutions D30N/N65D. In some embodiments, the IL-15 complex comprises from N- to C-terminus: a human IL-15 Rα sushi domain, a domain linker, and a human mature IL-15 variant having amino acid substitutions D30N/E64Q/N65D.

In some embodiments, the central-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 (including a human mature IL-15 variant). In some embodiments, the central-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions N4D/N65D. In some embodiments, the central-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/N65D. In some embodiments, the central-scIL-15/Rα comprises an anti-PD-1 ABD having the sequence of XENP26940 or 1C11_H3.303_L3.152 as shown in FIG. 94N, a human IL-15 Rα(sushi) domain, and a human mature IL-15 variant having amino acid substitutions D30N/E64Q/N65D.

In some embodiments, the central-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 (including a human mature IL-15 variant). In some embodiments, the central-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions N4D/N65D. In some embodiments, the central-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/N65D. In some embodiments, the central-scIL-15/Rα comprises an anti-PD-1 ABD having the sequence of XENP28026 or 1C11_H3.329_L3.220 as shown in FIG. 94AE, a human IL-15 Rα(sushi) domain, and a human mature IL-15 variant having amino acid substitutions D30N/E64Q/N65D.

In some embodiments, the central-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 (including a human mature IL-15 variant). In some embodiments, the central-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions N4D/N65D. In some embodiments, the central-scIL-15/Rα comprises an anti-PD-1 ABD having the sequence o of XENP28652 or 1C11_H3.328_L3.152 as shown in FIG. 94AG, a human IL-15 Rα(sushi) domain, and a human mature IL-15 variant having amino acid substitutions D30N/N65D. In some embodiments, the central-scIL-15/Rα comprises an anti-PD-1 ABD having the sequence of XENP28652 or 1C11_H3.328_L3.152 as shown in FIG. 94AG, a human IL-15 Rα(sushi) domain, and a human mature IL-15 variant having amino acid substitutions D30N/E64Q/N65D.

V. IL-15/IL-15Rα-Fc Fusion Monomers

The Fc fusion proteins of the present invention include an IL-15/IL-15 receptor alpha (IL-15Rα)-Fc fusion monomer; reference is made to WO2018/171918, WO2018/071919, US2018/0118805, US2018/0118828, U.S. Ser. No. 62/408,655, filed on Oct. 14, 2016, U.S. Ser. No. 62/443,465, filed on Jan. 6, 2017, and U.S. Ser. No. 62/477,926, filed on Mar. 28, 2017, hereby incorporated by reference in their entirety and in particular for the figures, figure legends, and sequences outlined therein.

In some embodiments, the human IL-15 protein has the amino acid sequence set forth in NCBI Ref. Seq. No. NP_000576.1 or SEQ ID NO:1. In some cases, the coding sequence of human IL-15 is set forth in NCBI Ref. Seq. No. NM_000585. An exemplary IL-15 protein of the Fc fusion heterodimeric protein outlined herein can have the amino acid sequence of SEQ ID NO:2 or amino acids 49-162 of SEQ ID NO:1.

SEQ ID NO: 1 is
MRISKPHLRSISIQCYLCLLLNSHFLTEAGIHVFILGCFSAGLPKTEANW

VNVISDLKKIEDLIQSMHIDATLYTESDVHPSCKVTAMKCFLLELQVISL

ESGDASIHDTVENLIILANNSLSSNGNVTESGCKECEELEEKNIKEFLQS

FVHIVQMFINTS.

SEQ ID NO: 2 is
NWVNVISDLKKIEDLIQSMHIDATLYTESDVHPSCKVTAMKCFLLELQVI

SLESGDASIHDTVENLIILANNSLSSNGNVTESGCKECEELEEKNIKEFL

QSFVHIVQMFINTS.

In some embodiments, the IL-15 protein has at least 90%, e.g., 90%, 91%, 92%, 93%, 94%, 95%, 96%, 97%, 98%, 99%, or more sequence identity to SEQ ID NO:2. In some embodiments, the IL-15 protein has the amino acid sequence of SEQ ID NO:2 and one or more amino acid substitutions selected from the group consisting of C42S, L45C, Q48C, V49C, L52C, E53C, E87C, and E89C. In some embodiments, the IL-15 protein has one or more amino acid substitutions selected from the group consisting of N1D, N4D, D8N, D30N, D61N, E64Q, N65D, and Q108E. The IL-15 protein of the Fc fusion protein can have 1, 2, 3, 4, 5, 6, 7, 8, 9 or more amino acid substitutions. In some embodiments, the IL-15 protein has the amino acid sequence of SEQ ID NO:2 and one or more amino acid substitutions selected from the group consisting of N1D, N4D, D8N, D30N, D61N, E64Q, N65D, and Q108E. In other embodiments, the amino acid substitutions are N4D/N65D. In other embodiments, the amino acid substitutions are D30N/E64Q/N65D. In some instances, the amino acid substitutions are D30N/N65D. In some embodiments, the IL-15 protein has at least 97% or 98% sequence identity to SEQ ID NO:2 and N4D/N65D substitutions. In some embodiments, the IL-15 protein has at least 97% or 98% sequence identity to SEQ ID NO:2 and D30N/N65D substitutions. In some embodiments, the IL-15 protein has at least 96% or 97% sequence identity to SEQ ID NO:2 and D30N/N65D substitutions.

In some embodiments, the human IL-15 receptor alpha (IL-15Rα) protein has the amino acid sequence set forth in NCBI Ref. Seq. No. NP_002180.1 or SEQ ID NO:3. In some cases, the coding sequence of human IL-15Rα is set forth in NCBI Ref. Seq. No. NM_002189.3. An exemplary the IL-15Rα protein of the Fc fusion heterodimeric protein outlined herein can comprise or consist of the sushi domain of SEQ ID NO:3 (e.g., amino acids 31-95 of SEQ ID NO:3), or in other words, the amino acid sequence of SEQ ID NO:4.

SEQ ID NO: 3 is
MAPRRARGCRTLGLPALLLLLLLRPPATRGITCPPPMSVEHADIWVKSYSL

YSRERYICNSGFKRKAGTSSLTECVLNKATNVAHWTTPSLKCIRDPALVHQ

RPAPPSTVTTAGVTPQPESLSPSGKEPAASSPSSNNTAATTAAIVPGSQLM

PSKSPSTGTTEISSHESSHGTPSQTTAKNWELTASASHQPPGVYPQGHSDT

TVAISTSTVLLCGLSAVSLLACYLKSRQTPPLASVEMEAMEALPVTWGTSS

RDEDLENCSHHL.

SEQ ID NO:4 is
ITCPPPMSVEHADIWVKSYSLYSRERYICNSGFKRKAGTSSLTECVLNKAT

NVAHWTTPSLKCIR.

In some embodiments, the IL-15Rα protein has the amino acid sequence of SEQ ID NO:4 and an amino acid insertion selected from the group consisting of D96, P97, A98, D96/P97, D96/C97, D96/P97/A98, D96/P97/C98, and D96/C97/A98, wherein the amino acid position is relative to full-length human IL-15Rα protein or SEQ ID NO:3. For instance, amino acid(s) such as D (e.g., Asp), P (e.g., Pro), A (e.g., Ala), DP (e.g., Asp-Pro), DC (e.g., Asp-Cys), DPA (e.g., Asp-Pro-Ala), DPC (e.g., Asp-Pro-Cys), or DCA (e.g., Asp-Cys-Ala) can be added to the C-terminus of the IL-15Rα protein of SEQ ID NO:4. In some embodiments, the IL-15Rα protein has the amino acid sequence of SEQ ID NO:4 and one or more amino acid substitutions selected from the group consisting of K34C, A37C, G38C, S40C, and L42C, wherein the amino acid position is relative to SEQ ID NO:4. The IL-15Rα protein can have 1, 2, 3, 4, 5, 6, 7, 8 or more amino acid mutations (e.g., substitutions, insertions and/or deletions).

VI. Domain Linkers

In some embodiments, an IL-15 protein is attached to the N-terminus of an Fc domain, and an IL-15Rα protein is attached to the N-terminus of the IL-15 protein. In other embodiments, an IL-15Rα protein is attached to the N-terminus of an Fc domain and the IL-15Rα protein is non-covalently attached to an IL-15 protein. In yet other embodiments, an IL-15Rα protein is attached to the C-terminus of an Fc domain and the IL-15Rα protein is non-covalently attached to an IL-15 protein.

In some embodiments, the IL-15 protein and IL-15Rα protein are attached together via a linker (e.g., a "scIL-15/Rα" format). Optionally, the proteins are not attached via a linker, and utilize either native self-assembly or disulfide bonds as outlined herein. In other embodiments, the IL-15 protein and IL-15Rα protein are noncovalently attached. In some embodiments, the IL-15 protein is attached to an Fc domain via a linker. In certain embodiments, the IL-15 protein is attached to an Fc domain directly, such as without a linker. In particular embodiments, the IL-15 protein is attached to an Fc domain via a hinge region or a fragment thereof. In other embodiments, the IL-15Rα protein is attached to an Fc domain via a linker. In other embodiments, the IL-15Rα protein is attached to an Fc domain directly, such as without a linker. In particular embodiments, the IL-15Rα protein is attached to an Fc domain via a hinge region or a fragment thereof. Optionally, a linker is not used to attach the IL-15 protein or IL-15Rα protein to the Fc domain.

In some instances, the PD-1 ABD is covalently attached to the N-terminus of an Fc domain via a linker, such as a domain linker. In some embodiments, the PD-1 ABD is attached to an Fc domain directly, such as without a linker. In particular embodiments, the PD-1 ABD is attached to an Fc domain via a hinge region or a fragment thereof.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO: 1217), (GGGGS)n (SEQ ID NO: 1218), and (GGGS)n (SEQ ID NO: 1219), where n is an integer of at least 1 (and generally from 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers can be used as discussed herein and shown in FIGS. 9 and 10.

VII. PD-1 Antibody Monomers

The present invention relates to the generation of bispecific heterodimeric proteins that bind to a PD-1 and cells expressing IL-2Rβ and the common gamma chain (γc; CD132). The bispecific heterodimeric protein can include an antibody monomer of any useful antibody format that can bind to an immune checkpoint antigen. In some embodiments, the antibody monomer includes a Fab or a scFv linked to an Fc domain. In some cases, the PD-1 antibody monomer contains an anti-PD1(VH)-CH1-Fc and an anti-PD-1 VL-Ckappa. In some cases, the PD-1 antibody monomer contains an anti-PD-1 scFv-Fc.

In some embodiments, the PD-1 targeting arm of the heterodimeric Fc fusion proteins of the invention comprises sequences for VHCDR1, VHCDR2, VHCDR3, VLCDR1, VLCDR2, and VLCDR3 selected from the CDRs of the group consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the sequences for VHCDR1, VHCD2, and VHCDR3 are selected from the sequences depicted in FIGS. 95A-95J, and the corresponding sequence identifiers. In some embodiments, the sequences for VHCDR1, VHCD2, and VHCDR3 are selected from the sequences depicted in FIGS. 96A-96F, and the corresponding sequence identifiers.

In some embodiments, the PD-1 targeting arm of the heterodimeric Fc fusion proteins of the invention comprises a variable heavy domain and a variable light domain from the pair selected from the group consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the variable heavy domain of the PD-1 targeting arm has at least 85%, 86%, 87%, 88%, 89%, 90%, 91%, 92%, 93%, 94%, 95%, 96%, 97%, 98%, 99% or more sequence identity to the sequence of the variable heavy domain and the variable light domain of the PD-1 targeting arm has at least 85%, 86%, 87%, 88%, 89%, 90%, 91%, 92%, 93%, 94%, 95%, 96%, 97%, 98%, 99% or more sequence identity to the sequence of the variable light domain selected from the group consisting of the pair from 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, 1C11[PD-1]_H3.328_L3.152 from XENP28652, and the corresponding sequence identifiers.

Additional exemplary embodiments of such antibody fragments are provided in XENP21480 (chain 2; FIG. 65A), XENP22022 (chains 2 and 3; FIG. 65D), XENP22112 (chains 1 and 4; FIG. 65E), XENP22641 (chains 1 and 3; FIG. 65F), XENP22642 (chains 1-3; FIG. 65H), and XENP22644 (chains 1-3; FIG. 65I).

The ABD can be in a variety of formats, such as in a Fab format or in an scFv format. Exemplary ABDs for use in the present invention are disclosed in WO2017/218707 and PCT/US2018/059887, the contents including the figures, figure legends, and sequence listings are hereby incorporated in its entirety for all purposes.

For instance, suitable ABDs that bind PD-1 are shown in FIGS. 11 and 12 of US2018/0118836, as well as those outlined in FIG. 13 and FIG. 14 and the SEQ ID NOS: herein. As will be appreciated by those in the art, suitable ABDs can comprise a set of 6 CDRs as depicted in the Figures herein, either as they are underlined or, in the case where a different numbering scheme is used as described above, as the CDRs that are identified using other alignments within the vh and vl sequences of FIGS. 11 and 12 of US2018/0118836. Suitable ABDs can also include the entire vh and vl sequences as depicted in these Figures, used as scFvs or as Fabs. Specific scFv sequences are shown in FIG. 11 of US2018/0118836, with a particular charged linker, although other linkers, such as those depicted in FIG. 7, can also be used. In many of the embodiments herein that contain an Fv to PD-1, it is the scFv monomer that binds PD-1. In US2018/0118836, FIG. 11 shows preferred scFv sequences, and FIG. 12 depicts suitable Fab sequences, although as discussed herein, vh and vl of can be used in either configuration.

B. Antibodies

As is discussed below, the term "antibody" is used generally. Antibodies that find use in the present invention can take on a number of formats as described herein, including traditional antibodies as well as antibody derivatives, fragments and mimetics, described herein and depicted in the figures. The present invention provides antibody fusion proteins containing a checkpoint antigen binding domain and an Fc domain. In some embodiments, the antibody fusion protein forms a bispecific heterodimeric protein with an IL-15/IL-15Rα-Fc protein described herein. In other embodiments, the antibody fusion protein forms a bispecific heterodimeric protein with another antibody fusion protein comprising a checkpoint antigen binding domain and an Fc domain. Embodiments of such PD-1-targeted heterodimeric proteins include, but are not limited to, XENP21480, XENP22022, XENP22112, XENP22641, XENP22642, XENP22644, XENP25850, and XENP25937.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vlCDRs (e.g., vlCDR1, vlCDR2 and vlCDR3).

A useful comparison of CDR numbering is as below, see Lafranc et al., Dev. Comp. Immunol. 27(1):55-77 (2003):

TABLE 1

|        | Kabat + Chothia | IMGT    | Kabat   | AbM    | Chothia | Contact | Xencor  |
|--------|-----------------|---------|---------|--------|---------|---------|---------|
| vhCDR1 | 26-35           | 27-38   | 31-35   | 26-35  | 26-32   | 30-35   | 27-35   |
| vhCDR2 | 50-65           | 56-65   | 50-65   | 50-58  | 52-56   | 47-58   | 54-61   |
| vhCDR3 | 95-102          | 105-117 | 95-102  | 95-102 | 95-102  | 93-101  | 103-116 |
| vlCDR1 | 24-34           | 27-38   | 24-34   | 24-34  | 24-34   | 30-36   | 27-38   |
| vlCDR2 | 50-56           | 56-65   | 50-56   | 50-56  | 50-56   | 46-55   | 56-62   |
| vlCDR3 | 89-97           | 105-117 | 89-97   | 89-97  | 89-97   | 89-96   | 97-105  |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the Fv region), and a constant light chain region (often referred to as CL or Cκ).

Another region of interest for additional substitutions, outlined above, is the Fc region.

As described herein and known in the art, the ABDs of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the —CH2-CH3 domain, and optionally a hinge domain. In the embodiments herein, when a scFv is attached to an Fc domain, it is the C-terminus of the scFv construct that is attached to all or part of the hinge of the Fc domain; for example, it is generally attached to the sequence EPKS (SEQ ID NO:1220) which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, C-terminus of the variable light chain is attached to the N-terminus of the scFv linker, the C-terminus of which is attached to the N-terminus of a variable heavy chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIGS. 4A-4B of U.S. 62/353,511).

As shown herein, there are a number of suitable scFv linkers that can be used, including traditional peptide bonds, generated by recombinant techniques. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 1217), (GGGGS)n (SEQ ID NO: 1218), and (GGGS)n (SEQ ID NO: 1219), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example Cκ or Cλ. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g. TCR, FcR, KIR), hinge region-derived sequences, and other natural sequences from other proteins.

In some embodiments, the linker is a "domain linker", used to link any two domains as outlined herein together. While any suitable linker can be used, many embodiments utilize a glycine-serine polymer, including for example (GS)n, (GSGGS)n (SEQ ID NO: 1217), (GGGGS)n (SEQ ID NO: 1218), and (GGGS)n (SEQ ID NO: 1219), where n is an integer of at least one (and generally from 3 to 4 to 5) as well as any peptide sequence that allows for recombinant attachment of the two domains with sufficient length and flexibility to allow each domain to retain its biological function. In some cases, and with attention being paid to "strandedness", as outlined below, charged domain linkers, as used in some embodiments of scFv linkers can be used.

In some embodiments, the scFv linker is a charged scFv linker, a number of which are shown in FIG. 10. Accordingly, the present invention further provides charged scFv linkers, to facilitate the separation in pI between a first and a second monomer (e.g., an IL-15/IL-15Rα monomer and PD-1 ABD monomer). That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 10 can be used in any embodiment herein where a linker is utilized.

In one embodiment, the antibody is an antibody fragment, as long as it contains at least one constant domain which can be engineered to produce heterodimers, such as pI engineering. Other antibody fragments that can be used include fragments that contain one or more of the CHL CH2, CH3, hinge and CL domains of the invention that have been pI engineered. In particular, the formats depicted in FIGS. 65A-65K are PD-1 targeted heterodimeric Fc fusion proteins, referred to as "bispecific heterodimeric fusion proteins", meaning that the protein has at least two associated Fc sequences self-assembled into a heterodimeric Fc domain and at least one Fv regions, whether as Fabs or as scFvs.

C. Chimeric and Humanized Antibodies

In some embodiments, the antibodies herein can be derived from a mixture from different species, e.g., a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention). In one embodiment, the parent antibody has been affinity matured, as is known in the art. Structure-based methods may be employed for humanization and affinity maturation, for example as described in U.S. Pat. No. 7,657,380. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VIII. Useful Embodiments of the Invention

As will be appreciated by those in the art and discussed more fully below, the PD-1-targeted IL-15/Rα-Fc heterodimeric fusion proteins of the present invention can take on a wide variety of configurations, as are generally depicted in FIGS. 65A-65K. The amino acid sequences of exemplary PD-1-targeted IL-15/Rα-Fc fusion proteins are provided in FIGS. 66, 67, 68, 69A, 69B, 69C, 70, 71, 72A, 72B, 73A, 73B, 74A, 74B, 75, 76, 126A-126D, 127A-127D, and 128A-128L.

Provided herein are PD-1-targeted IL-15/Rα-Fc fusion proteins of the scIL-15/RαxFab format. In some embodiments, the PD-1-targeted IL-15/Rα-Fc fusion protein comprises: (a) a first monomer comprising from N- to C-terminal: a human IL-15Rα(sushi) domain, a domain linker, a human mature IL-15 variant, a domain linker, and a first Fc variant domain comprising CH2-CH3; (b) a second monomer comprising from N- to C-terminal: a heavy chain comprising VH-CH1-hinge-CH2-CH3 such that CH2-CH3 of the second monomer is a second Fc variant domain; (c) a light chain comprising VL-CL such that the VH and VL form an antigen binding domain that binds human PD-1. In some embodiments, the VH and VL are selected from the group of pair consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the sequences of the VH and VL of the antigen binding domain are depicted in FIGS. 93A-93S and FIGS. 94A-94AP and the corresponding sequence identifiers.

In some embodiments, the human IL-15Rα(sushi) domain is SEQ ID NO:4. In some embodiments, the human mature IL-15 variant is SEQ ID NO:2. In some embodiments, the human mature IL-15 variant is SEQ ID NO:2 with amino acid substitutions N4D/N65D. In certain embodiments, the human mature IL-15 variant is SEQ ID NO:2 with amino acid substitutions D30N/N65D. In some embodiments, the human mature IL-15 variant is SEQ ID NO:2 with amino acid substitutions D30N/E64Q/N65D.

In some embodiments, the first Fc variant domain of the scIL-15/RαxFab format comprises amino acid substitutions C220S, L368D/K370S, Q295E/N384D/Q418E/N421D, and E233P/L234V/L235A/G236del/S267K, and optionally, M248L/N434S; and the second Fc variant domain comprises amino acid substitutions S364K/E357Q and E233P/L234V/L235A/G236del/S267K, and optionally, M248L/N434S.

In some embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with N4D/N65D substitutions, and a first Fc variant domain comprising amino acid substitutions C220S, L368D/K370S, Q295E/N384D/Q418E/N421D, E233P/L234V/L235A/G236del/S267K, and optionally, M248L/N434S; a second monomer comprising a heavy chain comprising VH-CH1-hinge-CH2-CH3 wherein the CH2-CH3 is a second Fc variant domain comprising amino acid substitutions S364K/E357Q, E233P/L234V/L235A/G236del/S267K, and optionally, M248L/N434S; and a light chain comprising VL-CL, wherein the VH and VL are from 1C11[PD-1]_H3L3 from XENP22553. In some embodiments, the VH and VL of the PD-1-targeted IL-15/Rα-Fc fusion protein are from 1C11[PD-1]_H3.234_L3.144 from XENP25806. In some embodiments, the VH and VL of the PD-1-targeted IL-15/Rα-Fc fusion protein are from 1C11 [PD-1]_H3.240_L3.148 from XENP25812. In some embodiments, the VH and of the PD-1-targeted IL-15/Rα-Fc fusion protein are from 1C11[PD-1]_H3.241_L3.148 from XENP25813. In some embodiments, the VH and VL of the PD-1-targeted IL-15/Rα-Fc fusion protein are from 1C11[PD-1]_H3.241_L3.92 from XENP25819. In some embodiments, the VH and VL of the PD-1-targeted IL-15/Rα-Fc fusion protein are from 1C11[PD-1]_H3.303_L3.152 from XENP26940. In some embodiments, the VH and VL are from 1C11[PD-1]_H3.329_L3.220 from XENP28026. In some embodiments, the VH and VL of the PD-1-targeted IL-15/Rα-Fc fusion protein are from 1C11[PD-1]_H3.328_L3.152 from XENP28652. As will be understood from those in the art, the variable heavy and light domains of the scFv come in "pairs" as will be apparent from the sequence identifiers and corresponding FIGS. 93A-93S and FIGS. 94A-94AP. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In other embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with D30N/N65D substitutions, and a first Fc variant domain comprising amino acid substitutions C220S, L368D/K370S, Q295E/N384D/Q418E/N421D, E233P/L234V/L235A/G236del/S267K, and optionally, M248L/N434S; a second monomer comprising a heavy chain comprising VH-CH1-hinge-CH2-CH3 wherein the CH2-CH3 is a second Fc variant domain comprising amino acid substitutions S364K/E357Q, E233P/L234V/L235A/G236del/S267K, and optionally, M248L/N434S; and a light chain comprising VL-CL, wherein the VH and VL of the PD-1-targeted IL-15/Rα-Fc fusion protein are from 1C11[PD-1]_H3L3 from XENP22553. In some embodiments, the VH and VL of the PD-1-targeted IL-15/Rα-Fc fusion protein are from 1C11[PD-1]_H3.234_L3.144 from XENP25806. In some embodiments, the VH and VL of the PD-1-targeted IL-15/Rα-Fc fusion protein are from 1C11[PD-1]_H3.240_L3.148 from XENP25812. In some embodiments, the VH and VL of the PD-1-targeted IL-15/Rα-Fc fusion protein are from 1C11[PD-1]_H3.241_L3.148 from XENP25813. In some embodiments, the VH and VL of the PD-1-targeted IL-15/Rα-Fc fusion protein are from 1C11 [PD-1]_H3.241_L3.92 from XENP25819. In some embodiments, the VH and VL of the PD-1-targeted IL-15/Rα-Fc fusion protein are from 1C11[PD-1]_H3.303_L3.152 from XENP26940. In some embodiments, the VH and VL of the PD-1-targeted IL-15/Rα-Fc fusion protein are from 1C11 [PD-1]_H3.329_L3.220 from XENP28026. In some embodiments, the VH and VL of the PD-1-targeted IL-15/Rα-Fc fusion protein are from and 1C11[PD-1]_H3.328_L3.152 from XENP28652. As will be understood from those in the art, the variable heavy and light domains of the scFv come in "pairs" as will be apparent from the sequence identifiers and corresponding FIGS. 93A-93S and FIGS. 94A-94AP. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In some embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with D30N/E64Q/N65D substitutions, and a first Fc variant domain comprising amino acid substitutions C220S, L368D/K370S, Q295E/N384D/Q418E/N421D, E233P/L234V/L235A/G236del/S267K, and optionally, M248L/N434S; a second monomer comprising a heavy chain comprising VH-CH1-hinge-CH2-CH3 wherein the CH2-CH3 is a second Fc variant domain comprising amino acid substitutions S364K/E357Q, E233P/L234V/L235A/G236del/S267K, and optionally, M248L/N434S; and a light chain comprising VL-CL, wherein the VH and VL of the PD-1-targeted IL-15/Rα-Fc fusion protein are from 1C11 [PD-1]_H3L3 from XENP22553. In some embodiments, the VH and VL of the PD-1-targeted IL-15/Rα-Fc fusion protein are from 1C11[PD-1]_H3.234_L3.144 from XENP25806. In some embodiments, the VH and VL of the PD-1-targeted IL-15/Rα-Fc fusion protein are from 1C11[PD-1]_H3.240_L3.148 from XENP25812. In some embodiments, the VH and VL of the PD-1-targeted IL-15/Rα-Fc fusion protein are from 1C11[PD-1]_H3.241_L3.148 from XENP25813. In some embodiments, the VH and VL of the PD-1-targeted IL-15/Rα-Fc fusion protein are from 1C11 [PD-1]_H3.241_L3.92 from XENP25819. In some embodiments, the VH and VL of the PD-1-targeted IL-15/Rα-Fc fusion protein are from 1C11[PD-1]_H3.303_L3.152 from XENP26940. In some embodiments, the VH and VL of the PD-1-targeted IL-15/Rα-Fc fusion protein are from 1C11 [PD-1]_H3.329_L3.220 from XENP28026. In some embodiments, the VH and VL of the PD-1-targeted IL-15/Rα-Fc fusion protein are from and 1C11[PD-1]_H3.328_L3.152 from XENP28652. As will be understood from those in the art, the variable heavy and light domains of the scFv come in "pairs" as will be apparent from the sequence identifiers and corresponding FIGS. 93A-93S and FIGS. 94A-94AP. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In some embodiments, the scIL-15/Rα×anti-PD-1 Fab is depicted in FIGS. 126A-126D, FIGS. 127A-127K, FIGS. 128A-128L, and the corresponding sequence identifiers and SEQ ID NOS of the sequence listing.

Provided herein are PD-1-targeted IL-15/Rα-Fc fusion proteins of the scIL-15/Rα×scFv format. In some embodiments, the PD-1-targeted IL-15/Rα-Fc fusion protein comprises: (a) a first monomer comprising from N- to C-terminal: a human IL-15Rα(sushi) domain, a domain linker, a human mature IL-15 variant, an optional domain linker, and a first Fc variant domain comprising CH2-CH3; and (b) a second monomer comprising from N- to C-terminal: a scFv domain that binds human PD-1 such that the scFv comprises a variable heavy domain (VH), an scFv linker, and a variable light domain (VL) (e.g., in some cases, the scFv comprises from N- to C-terminus: a VH-scFv linker-VL or in other cases, the scFv comprises from N- to C-terminus: a VL-scFv linker-VH); and a second Fc variant domain. In some embodiments, the VH and VL are selected from the group of pair consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the sequences of the VH and VL of the antigen binding domain are depicted in FIGS. 93A-93S and FIGS. 94A-94AP and the corresponding sequence identifiers.

In some embodiments, the human IL-15Rα(sushi) domain is SEQ ID NO:4. In some embodiments, the human mature IL-15 variant is SEQ ID NO:2. In some embodiments, the human mature IL-15 variant is SEQ ID NO:2 with amino acid substitutions N4D/N65D. In certain embodiments, the human mature IL-15 variant is SEQ ID NO:2 with amino acid substitutions D30N/N65D. In some embodiments, the human mature IL-15 variant is SEQ ID NO:2 with amino acid substitutions D30N/E64Q/N65D.

In some embodiments, the first Fc variant domain of the scIL-15/Rα×scFv format comprises amino acid substitutions C220S, L368D/K370S, Q295E/N384D/Q418E/N421D, and E233P/L234V/L235A/G236del/S267K, and optionally, M248L/N434S; and the second Fc variant domain comprises amino acid substitutions C220S, S364K/E357Q and E233P/L234V/L235A/G236del/S267K, and optionally, M248L/N434S.

In particular embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2, an optional domain linker, and a first Fc variant domain comprising amino acid substitutions C220S, L368D/K370S, Q295E/N384D/Q418E/N421D, E233P/L234V/L235A/G236del/S267K, and optionally, M248L/N434S; and a second monomer comprising an anti-PD-1 scFv and a second Fc variant domain comprising amino acid substitutions C220S, S364K/E357Q, E233P/L234V/L235A/G236del/S267K, and optionally, M248L/N434S. In some embodiments, the anti-PD-1 scFv comprises sequences for VHCDR1, VHCD2, VHCDR3, VLCDR1, VLCDR2, and VLCDR3 from 1C11[PD-1]_H3L3 from XENP22553. In some embodiments, the CDRs are from 1C11[PD-1]_H3.234_L3.144 from XENP25806. In some embodiments, the CDRs are from 1C11[PD-1]_H3.240_L3.148 from XENP25812. In some embodiments, the CDRs are from 1C11[PD-1]_H3.241_L3.148 from XENP25813. In some embodiments, the CDRs are from 1C11[PD-1]_H3.241_L3.92 from XENP25819. In some embodiments, the CDRs are from 1C11[PD-1]_H3.303_L3.152 from XENP26940. In some embodiments, the CDRs are from 1C11[PD-1]_H3.329_L3.220 from XENP28026. In some embodiments, the CDRs are from and 1C11[PD-1]_H3.328_L3.152 from XENP28652. As will be understood from those in the art, the CDRs for the variable heavy and light domains of the scFv come in "pairs" as will be apparent from the sequence identifiers. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In some embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with N4D/N65D substitutions, an optional domain linker, and a first Fc variant domain comprising amino acid substitutions C220S, L368D/K370S, Q295E/N384D/Q418E/N421D, E233P/L234V/L235A/G236del/S267K, and optionally, M248L/N434S; and a second monomer comprising an anti-PD-1 scFv and a second Fc variant domain comprising amino acid substitutions C220S, S364K/E357Q, E233P/L234V/L235A/G236del/S267K, and optionally, M248L/N434S. In some embodiments, the anti-PD-1 scFv comprises sequences for VHCDR1, VHCD2, VHCDR3, VLCDR1, VLCDR2, and VLCDR3 from 1C11[PD-1]_H3L3 from XENP22553. In some embodiments, the CDRs are from 1C11[PD-1]_H3.234_L3.144 from XENP25806. In some embodiments, the CDRs are from 1C11[PD-1]_H3.240_L3.148 from XENP25812. In some embodiments, the CDRs are from 1C11[PD-1]_H3.241_L3.148 from XENP25813. In some embodiments, the CDRs are from 1C11[PD-1]_H3.241_L3.92 from XENP25819. In some embodiments, the CDRs are from 1C11[PD-1]_H3.303_L3.152 from XENP26940. In some embodiments, the CDRs are from 1C11[PD-1]_H3.329_L3.220 from XENP28026. In some embodiments, the CDRs are from and 1C11[PD-1]_H3.328_L3.152 from XENP28652. As will be understood from those in the art, the CDRs for the variable heavy and light domains of the scFv come in "pairs" as will be apparent from the sequence identifiers. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In some embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with D30N/N65D substitutions, an optional domain linker, and a first Fc variant domain comprising amino acid substitutions C220S, L368D/K370S, Q295E/N384D/Q418E/N421D, E233P/L234V/L235A/G236del/S267K, and optionally, M248L/N434S; and a second monomer comprising an anti-PD-1 scFv and a second Fc variant domain comprising amino acid substitutions C220S, S364K/E357Q, E233P/L234V/L235A/G236del/S267K, and optionally, M248L/N434S. In some embodiments, the anti-PD-1 scFv comprises sequences for VHCDR1, VHCD2, VHCDR3, VLCDR1, VLCDR2, and VLCDR3 from 1C11[PD-1]_H3L3 from XENP22553. In some embodiments, the CDRs are from 1C11[PD-1]_H3.234_L3.144 from XENP25806. In some embodiments, the CDRs are from 1C11[PD-1]_H3.240_L3.148 from XENP25812. In some embodiments, the CDRs are from 1C11[PD-1]_H3.241_L3.148 from XENP25813. In some embodiments, the CDRs are from 1C11[PD-1]_H3.241_L3.92 from XENP25819. In some embodiments, the CDRs are from 1C11[PD-1]_H3.303_L3.152 from XENP26940. In some embodiments, the CDRs are from 1C11[PD-1]_H3.329_L3.220 from XENP28026. In some embodiments, the CDRs are from and 1C11[PD-1]_H3.328_L3.152 from XENP28652. As will be understood from those in the art, the CDRs for the variable heavy and light domains of the scFv come in "pairs" as will be apparent from the sequence identifiers. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In particular embodiments, the PD-1-targeted IL-15/Rα-Fc fusion protein comprises: a first monomer comprising from N- to C-terminal: a human IL-15Rα(sushi) domain of SEQ ID NO:4, a domain linker, a human mature IL-15 variant of SEQ ID NO:2 with D30N/E64Q/N65D substitutions, an optional domain linker, and a first Fc variant domain comprising amino acid substitutions C220S, L368D/K370S, Q295E/N384D/Q418E/N421D, E233P/L234V/L235A/G236del/S267K, and optionally, M248L/N434S; and a second monomer comprising an anti-PD-1 scFv and a second Fc variant domain comprising amino acid substitutions C220S, S364K/E357Q, E233P/L234V/L235A/G236del/S267K, and optionally, M248L/N434S. In some embodiments, the anti-PD-1 scFv comprises sequences for VHCDR1, VHCD2, VHCDR3, VLCDR1, VLCDR2, and VLCDR3 from 1C11[PD-1]_H3L3 from XENP22553. In some embodiments, the CDRs are from 1C11[PD-1]_H3.234_L3.144 from XENP25806. In some embodiments, the CDRs are from 1C11[PD-1]_H3.240_L3.148 from XENP25812. In some embodiments, the CDRs are from 1C11[PD-1]_H3.241_L3.148 from XENP25813. In some embodiments, the CDRs are from 1C11[PD-1]_H3.241_L3.92 from XENP25819. In some embodiments, the CDRs are from 1C11[PD-1]_H3.303_L3.152 from XENP26940. In some embodiments, the CDRs are from 1C11[PD-1]_H3.329_L3.220 from XENP28026. In some embodiments, the CDRs are from and 1C11[PD-1]_H3.328_L3.152 from XENP28652. As will be understood from those in the art, the CDRs for the variable heavy and light domains of the scFv come in "pairs" as will be apparent from the sequence identifiers. In some instances, the first Fc variant domain comprises CH2-CH3. In other instances, the first Fc variant domain comprises hinge-CH2-CH3. In some embodiments, the Fc variant domain (e.g., the first and/or second Fc variant domain) is selected from the group consisting of the Fc domain of human IgG1, IgG2, IgG3, and IgG4. In some embodiments, the Fc variant domains is selected from the group consisting of the Fc domain of human IgG1, IgG2, and IgG4. In some embodiments, the Fc variant domains is selected from the group consisting of the Fc domain of human IgG1.

In some embodiments, the PD-1-targeted IL-15/Rα-Fc fusion proteins of the invention are administered to a patient, e.g., a human patient with cancer.

In some embodiments, provided herein is a nucleic acid composition comprising a nucleic acid encoding a first monomer of the present invention and a nucleic acid encoding a second monomer of the present invention.

In some embodiments, provided herein is an expression vector comprising a nucleic acid encoding a first monomer of the present invention. In some embodiments, provided herein is an expression vector comprising a nucleic acid encoding a second monomer of the present invention. In some embodiments, provided herein is an expression vector comprising a nucleic acid encoding the first monomer and a nucleic acid encoding the second monomer. In some embodiments, a host cell comprising one or more of the expression vectors described herein.

In some embodiments, provided herein is a nucleic acid composition comprising a nucleic acid encoding a first monomer of the present invention, a nucleic acid encoding second monomer of the present invention, and a nucleic acid encoding a light chain, such that the VH and VL of the PD-1-targeted IL-15/Rα-Fc fusion protein can bind PD-1.

In some embodiments, provided herein is an expression vector comprising a nucleic acid encoding a first monomer. In some embodiments, provided herein is an expression vector comprising a nucleic acid encoding second monomer. In some embodiments, provided herein is an expression vector comprising a nucleic acid encoding a first monomer and a nucleic acid encoding second monomer. In some embodiments, provided herein is an expression vector comprising a nucleic acid encoding a light chain, such that the VH and VL of the PD-1-targeted IL-15/Rα-Fc fusion protein can bind PD-1. In some embodiments, provided herein is an expression vector comprising a nucleic acid encoding a first monomer and a nucleic acid encoding a light chain. In some embodiments, provided herein is an expression vector comprising a nucleic acid encoding a second monomer and a nucleic acid encoding a light chain. In some embodiments, provided herein is an expression vector comprising a nucleic acid encoding a first monomer, a nucleic acid encoding second monomer, and a nucleic acid encoding a light chain. In some embodiments, provided herein is a host cell comprising one or more of the expression vectors described herein.

Provided herein is a method of making any one of the PD-1-targeted IL-15/Rα-Fc fusion proteins outlined herein comprising: culturing the host cell under conditions, such as cell culture conditions such that the PD-1-targeted IL-15/Rα-Fc fusion protein is expressed by the cell, and recovering the fusion protein.

Provided herein is a method of treating cancer in a patient comprising administering the PD-1-targeted IL-15/Rα-Fc fusion protein to the patient.

IX. Other Embodiments of the Invention

As will be appreciated by those in the art and discussed more fully below, the PD-1-targeted IL-15/Rα-Fc heterodimeric fusion proteins of the present invention can take on a wide variety of configurations, as are generally depicted in FIGS. 65A-65K. The amino acid sequences of exemplary PD-1-targeted IL-15/Rα-Fc fusion proteins are provided in FIGS. 66, 67, 68, 69A, 69B, 69C, 70, 71, 72A, 72B, 73A, 73B, 74A, 74B, 75, 76, 126A-126D, 127A-127D, and 128A-128L.

The present invention provides a PD-1-targeted IL-15/Rα-Fc fusion protein comprising a fusion protein and an antibody fusion protein. The fusion protein comprises a first protein domain, a second protein domain, and a first Fc domain. In some cases, the first protein domain is covalently attached to the N-terminus of the second protein domain using a first domain linker, the second protein domain is covalently attached to the N-terminus of the first Fc domain using a second domain linker, and the first protein domain comprises an IL-15Rα protein and the second protein domain comprises an IL-15 protein. The antibody fusion protein comprises a PD-1 antigen binding domain and a second Fc domain such that the PD-1 antigen binding domain is covalently attached to the N-terminus of the second Fc domain, and the PD-1 antigen binding domain is a single chain variable fragment (scFv) or a Fab fragment. In some embodiments, the first and the second Fc domains have a set of amino acid substitutions selected from the group consisting of S267K/L368D/K370S:S267K/LS364K/E357Q; S364K/E357Q:L368D/K370S; L368D/K370S: S364K; L368E/K370S:S364K; T411E/K360E/Q362E: D401K; L368D/K370S:S364K/E357L, L368D/K370S: S364K/E357Q, and K370S:S364K/E357Q, according to EU numbering. In some instances, the first and/or the second Fc domains have an additional set of amino acid substitutions comprising Q295E/N384D/Q418E/N421D, according to EU numbering. In some cases, the first and/or the second Fc domains have an additional set of amino acid substitutions consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

In some embodiments, the IL-15 protein has a polypeptide sequence selected from the group consisting of full-length human IL-15 and mature human IL-15, and the IL-15Rα protein has a polypeptide sequence selected from the group consisting of full-length human IL-15Rα and the sushi domain of human IL-15Rα. The IL-15 protein of the Fc fusion protein can have 1, 2, 3, 4, 5, 6, 7, 8 or 9 amino acid substitutions. In some embodiments, the human IL-15 protein of the Fc fusion protein has the amino acid substitution N4D. In some embodiments, the human IL-15 protein of the Fc fusion protein has the amino acid substitution N65D. In some embodiments, the human IL-15 protein of the Fc fusion protein has amino acid substitutions N4D/N65D. In some embodiments, the human IL-15 protein of the Fc fusion protein has amino acid substitutions D30N/E64Q/N65D. The IL-15 protein and the IL-15Rα protein can have a set of amino acid substitutions selected from the group consisting of E87C: D96/P97/C98; E87C: D96/C97/A98; V49C: S40C; L52C: S40C; E89C: K34C; Q48C: G38C; E53C: L42C; C42S: A37C; and L45C: A37C, respectively.

In some embodiments, the first protein domain is covalently attached to the N-terminus of the first Fc domain directly and without using the first domain linker and/or the second protein domain is covalently attached to the N-terminus of the second Fc domain directly and without using the second domain linker.

In some embodiments, the VH and VL of the PD-1 antigen binding domain are selected from the group of pair consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the VHCDR1, VHCD2, VHCDR3, VLCDR1, VLCDR2, and VLCDR3 of the PD-1 antigen binding domain are selected from the CDRs of the group consisting of 1C11[PD-1]_H3L3 from XENP22553, 1C11[PD-1]_H3.234_L3.144 from XENP25806, 1C11[PD-1]_H3.240_L3.148 from XENP25812, 1C11[PD-1]_H3.241_L3.148 from XENP25813, 1C11[PD-1]_H3.241_L3.92 from XENP25819, 1C11[PD-1]_H3.303_L3.152 from XENP26940, 1C11[PD-1]_H3.329_L3.220 from XENP28026, and 1C11[PD-1]_H3.328_L3.152 from XENP28652. In some embodiments, the sequences for VHCDR1, VHCD2, and VHCDR3 are selected from the sequences depicted in FIGS. 95A-95J, and the corresponding sequence identifiers. In some embodiments, the sequences for VHCDR1, VHCD2, and VHCDR3 are selected from the sequences depicted in FIGS. 96A-96F, and the corresponding sequence identifiers.

In some embodiments, the PD-1-targeted IL-15/Rα-Fc fusion protein comprises an IL-15Rα(sushi) protein fused to IL-15 protein by a variable length linker which is fused to the N-terminus of a first Fc domain of the heterodimeric Fc polypeptide and an anti-PD-1 scFv fused to the N-terminus of a second Fc domain of the heterodimeric Fc polypeptide (see, "scIL-15/RαxscFv" format and FIG. 65A). In some instances, the PD-1-targeted IL-15/Rα-Fc fusion protein is XENP21480. In certain instances, the PD-1-targeted IL-15/Rα-Fc fusion protein is a variant of XENP21480 comprising amino acid substitutions M428L/N434S on each Fc monomer.

In some embodiments, the PD-1-targeted IL-15/Rα-Fc fusion protein comprises an IL-15Rα(sushi) protein fused to an IL-15 protein by a variable length linker which is fused to the N-terminus of a first Fc domain of the heterodimeric Fc polypeptide and a variable heavy chain (VH) of an anti-PD-1 antibody fused to the N-terminus of a second Fc domain of the heterodimeric Fc polypeptide. A corresponding variable light chain (VL) of the anti-PD-1 antibody is transfected (e.g., introduced) separately and forms an anti-PD-1 Fab with the VH fused to the heterodimeric Fc polypeptide (see, "scIL-15/RαxFab" format and FIG. 65D). In some instances, the PD-1-targeted IL-15/Rα-Fc fusion protein selected from the group consisting of XENP22022, XENP25849, XENP24535, XENP24536, XENP25850, and XENP25937.

In some embodiments, the PD-1-targeted IL-15/Rα-Fc fusion protein comprises a variable heavy chain (VH) of an anti-PD-1 antibody fused to the N-terminus of a first Fc domain of the heterodimeric Fc polypeptide and an IL-15Rα (sushi) protein fused to the N-terminus of a second Fc domain of the heterodimeric Fc. A corresponding variable light chain (VL) of the anti-PD-1 antibody can be transfected separately and forms a Fab with the VH fused to the heterodimeric Fc polypeptide. An IL-15 protein can be transfected (e.g., introduced) separately and a non-covalent IL-15/Rα complex forms with the IL-15Rα(sushi) protein fused to the heterodimeric Fc polypeptide (see, "FabxncIL-15/Rα" format and FIG. 65E). In some instances, the PD-1-targeted IL-15/Rα-Fc fusion protein selected from the group consisting of XENP22112.

In some embodiments, the PD-1-targeted IL-15/Rα-Fc fusion protein comprises a variable heavy chain (VH) of an anti-PD-1 antibody fused to the N-terminus of a first Fc domain of the heterodimeric Fc polypeptide and an IL-15Rα (sushi) protein comprising one or more engineered cysteine substitutions fused to the N-terminus of a second Fc domain of the heterodimeric Fc. A corresponding variable light chain (VL) of the anti-PD-1 antibody can be transfected (e.g., introduced) separately and forms a Fab with the VH fused to the heterodimeric Fc polypeptide. An IL-15 protein comprising one or more engineered cysteine substitutions can be transfected (e.g., introduced) separately and an IL-15/Rα complex forms via disulfide bonds with the IL-15Rα (sushi) protein fused to the heterodimeric Fc polypeptide (see, "dsIL-15/RαxFab" format and FIG. 65F). In some instances, the PD-1-targeted IL-15/Rα-Fc fusion protein selected from the group consisting of XENP22641.

In certain embodiments, the PD-1-targeted IL-15/Rα-Fc fusion protein comprises a first variable heavy chain (VH) of an anti-PD-1 antibody fused to the N-terminus of a first Fc domain of the heterodimeric Fc polypeptide, a second variable heavy chain (VH) of the anti-PD-1 antibody fused to the N-terminus of a second Fc domain of the heterodimeric Fc polypeptide, and an IL-15Rα(sushi) protein fused to the C-terminus of either the first Fc domain or the second Fc domain of the heterodimeric Fc-region. Corresponding variable light chains (VL) of the anti-PD-1 antibody can be transfected (e.g., introduced) to form a first Fab with first variable heavy chain (VH) of the anti-PD-1 antibody and a second Fab with second variable heavy chain (VH) of the anti-PD-1 antibody of the heterodimeric Fc polypeptide. An IL-15 protein can be transfected (e.g., introduced) separately and a non-covalent IL-15/Rα complex forms with the IL-15Rα(sushi) protein fused to the heterodimeric Fc polypeptide (see, "mAbxncIL-15/Rα" format and FIG. 65H). In some instances, the PD-1-targeted IL-15/Rα-Fc fusion protein selected from the group consisting of XENP22642 and XENP22643.

In certain embodiments, the PD-1-targeted IL-15/Rα-Fc fusion protein comprises a first variable heavy chain (VH) of an anti-PD-1 antibody fused to the N-terminus of a first Fc domain of the heterodimeric Fc polypeptide, a second variable heavy chain (VH) of the anti-PD-1 antibody fused to the N-terminus of a second Fc domain of the heterodimeric Fc polypeptide, and an IL-15Rα(sushi) protein comprising one or more engineered cysteine substitutions fused to the C-terminus of either the first Fc domain or the second Fc domain of the heterodimeric Fc-region. Corresponding variable light chains (VL) of the anti-PD-1 antibody can be transfected (e.g., introduced) to form a first Fab with first variable heavy chain (VH) of the anti-PD-1 antibody and a second Fab with second variable heavy chain (VH) of the anti-PD-1 antibody of the heterodimeric Fc polypeptide. An IL-15 protein comprising one or more engineered cysteine substitutions can be transfected (e.g., introduced) separately and an IL-15/Rα complex forms via disulfide bonds with the IL-15Rα (sushi) protein fused to the heterodimeric Fc polypeptide (see, "mAbxdsIL-15/Rα" format and FIG. 65H). In some instances, the PD-1-targeted IL-15/Rα-Fc fusion protein selected from the group consisting of XENP22644 and XENP22645.

Also provided are nucleic acid compositions encoding the PD-1-targeted IL-15/Rα-Fc fusion protein described herein. In some instances, an expression vector comprising one or more nucleic acid compositions described herein. In some embodiments, a host cell comprising one or two expression vectors outlined herein is provided.

Provided herein are exemplary embodiments of PD-1 antigen binding domains (PD-1 ADBs) or anti-PD-1 antibodies that can be used as a PD-1 targeting arm of a PD-1-targeted IL-15/Rα-Fc fusion protein (see, e.g., Example 1).

Provided herein are PD-1-targeted IL-15/Rα-Fc fusion proteins with one or more engineered amino acid substitutions of the IL-15 protein. In some embodiments, the PD-1-targeted IL-15/Rα-Fc fusion proteins also include one or more engineered cysteine modifications at the IL-15/Rα interface (see, e.g., Example 2). Such PD-1-targeted IL-15/Rα-Fc fusion proteins can induce or promote proliferation of immune cells including NK cells, CD8$^+$ T cells, and CD4$^+$ T cells. Notably, IL-15/Rα-Fc containing fusion proteins that have no linker (e.g., hinge region only) on the IL-15 Fc side demonstrated weaker proliferative activity.

Provided herein are PD-1-targeted IL-15/Rα-Fc fusion proteins with lower potency, increased pharmacokinetics, and/or increased serum half-life. The PD-1-targeted IL-15/Rα-Fc fusion proteins described herein were engineered to decrease their potency compared to a parental construct (see, Example 2 and the Figures such as but not limited to FIGS. 44A-44C, 45A-45D, 47A-47B, 51A-51C, 52, 53A-53C, and the like). In some embodiments, one or more amino acid substitutions were introduced into the IL-15/Rα complex and/or in the Fc domain(s) of the heterodimeric Fc fusion protein. In some embodiments, PD-1-targeted IL-15/Rα-Fc fusion proteins with reduced potency compared to a control construct (e.g., a parental construct) have a substantially longer serum half-like. In certain embodiments, the serum half-life increased by 1x, 2x, 3x, 4x, 5x, 6x, 7x, 8x, 9x, 10x, 15x, 20x, 25x or more.

Provided herein are PD-1-targeted IL-15/Rα-Fc fusion proteins that enhanced GVHD in an animal model (e.g., a human PBMC-engrafted NSG mice) compared to the combination therapy of a control scIL-15/Rα-Fc heterodimeric Fc fusion protein engineered for reduced potency and an anti-PD-1 antibody. Administration of an exemplary PD-1-targeted IL-15/Rα-Fc fusion protein produced a greater effect compared to the combination of IL-15 and PD-1 blockade.

The PD-1-targeted IL-15/Rα-Fc fusion proteins described herein can induce STAT5 phosphorylation in immune cells including, but not limited to activated lymphocytes, activated T cells (e.g., activated CD4$^+$ T cells and activated CD8$^+$ cells), and activated tumor infiltrating lymphocytes.

In some embodiments, the PD-1 targeted IL-15/Rα heterodimeric Fc fusion protein is selected from the group consisting of XENP22022, XENP25849, XENP24535, XENP24536, XENP25850, and XENP25937. In certain embodiments, the PD-1 targeted IL-15/Rα-Fc fusion protein is selected from the group consisting XENP25850 and XENP25937.

In some aspects, provided herein is a pharmaceutical composition comprising an PD-1 targeted IL-15/Rα heterodimeric Fc fusion protein selected from the group consisting of XENP22022, XENP25849, XENP24535, XENP24536, XENP25850, and XENP25937; and a pharmaceutically acceptable carrier. In some embodiments, the PD-1 targeted IL-15/Rα heterodimeric Fc fusion protein is selected from the group consisting of XENP25850, and XENP25937.

In other aspects, provided herein is a pharmaceutical composition comprising any one of the PD-1 targeted IL-15/Rα heterodimeric Fc fusion proteins described herein and a pharmaceutically acceptable carrier.

In some aspects, provided herein is a method of treating cancer in a patient in need thereof comprising administering a therapeutically effective amount of any one of the PD-1 targeted IL-15/Rα heterodimeric Fc fusion proteins described herein or any one of the pharmaceutical compositions described herein to said patient.

In some embodiments, the method also comprises administering a therapeutically effective amount of a checkpoint blockade antibody. In some embodiments, the checkpoint blockade antibody is selected from an anti-PD-1 antibody, an anti-PD-L1 antibody, an anti-TIM3 antibody, an anti-TIGIT antibody, an anti-LAG3 antibody, and an anti-CTLA-4 antibody. In certain embodiments, the anti-PD-1 antibody is nivolumab, pembrolizumab, or pidilizumab. In particular embodiments, the anti-PD-L1 antibody is atezolizumab, avelumab, or durbalumab.

X. Nucleic Acids of the Invention

The invention further provides nucleic acid compositions encoding the PD-1 targeted IL-15/Rα heterodimeric Fc fusion protein of the invention (or, in the case of a monomer Fc domain protein, nucleic acids encoding those as well).

As will be appreciated by those in the art, the nucleic acid compositions will depend on the format of the PD-1 targeted IL-15/Rα-Fc fusion protein. Thus, for example, when the format requires three amino acid sequences, three nucleic acid sequences can be incorporated into one or more expression vectors for expression. Similarly, some formats only two nucleic acids are needed; again, they can be put into one or two expression vectors.

As is known in the art, the nucleic acids encoding the components of the invention can be incorporated into expression vectors as is known in the art, and depending on the host cells used to produce the PD-1 targeted IL-15/Rα Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer or component of the PD-1 targeted IL-15/Rα-Fc fusion protein, as applicable depending on the format, are each contained within a single expression vector, generally under different or the same promoter controls. In embodiments of particular use in the present invention, each of these two or three nucleic acids are contained on a different expression vector.

The PD-1 targeted IL-15/Rα heterodimeric Fc fusion protein of the invention are made by culturing host cells comprising the expression vector(s) as is well known in the art. Once produced, traditional fusion protein or antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that such that each monomer has a different pI and the heterodimer also has a distinct pI, thus facilitating isoelectric purification of the heterodimer (e.g., anionic exchange columns, cationic exchange columns). These substitutions also aid in the determination and monitoring of any contaminating homodimers post-purification (e.g., IEF gels, cIEF, and analytical IEX columns).

XI. Biological and Biochemical Functionality of PD-1-Targeted IL-15/Rα-Fc Fusion Proteins Generally the PD-1 targeted IL-15/Rα-Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+CD4$^+$ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD-1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD-1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD-1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers.

A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in $\alpha\beta$ and/or $\gamma\delta$ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases $\alpha\beta$ and/or $\gamma\delta$ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells. as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g. CD25, CD69, CD137, PD1), cytotoxicity (ability to kill target cells), and cytokine production (e.g. IL-2, IL-4, IL-6, IFN$\gamma$, TNF-$\alpha$, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g. IFN$\gamma$ and TNF), and cell surface receptor expression (e.g. CD25) would be indicative of immune modulation that would be consistent with enhanced killing of cancer cells.

In one embodiment, $\gamma\delta$ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an anti-PVRIG antibody of the invention. Similarly, increases of at least one-, two-, three-, four- or five-fold as compared to reference or control samples show efficacy.

XII. Checkpoint Blockade Antibodies

In some embodiments, the PD-1-targeted IL-15/R$\alpha$-Fc fusion proteins of the invention described herein are combined with other therapeutic agents including checkpoint blockade antibodies, such as but not limited to, a PD-1 inhibitor, a TIM3 inhibitor, a CTLA4 inhibitor, a PD-L1 inhibitor, a TIGIT inhibitor, a LAG3 inhibitor, or a combination thereof.

A. Anti-PD1 Antibodies

In some embodiments, a PD-1-targeted IL-15/R$\alpha$-Fc fusion protein described herein can be administered to a subject with cancer in combination with a checkpoint blockage antibody, e.g., an anti-PD-1 antibody. In some cases, the anti-PD-1 antibody includes XENP13432 (a bivalent anti-PD-1 mAb based on nivolumab with ablated effector function; amino acid sequence of XENP13432 is depicted in FIG. 86. In other cases, the anti-PD-1 antibody includes XENP25951 (a monovalent anti-PD-1 Fab-Fc based on the PD-1 targeting arm from XENP25850; amino acid sequence of XENP25951 is depicted in FIG. 87.

Exemplary non-limiting anti-PD-1 antibody molecules are disclosed in US 2015/0210769, published on Jul. 30, 2015, entitled "Antibody Molecules to PD-1 and Uses Thereof," incorporated by reference in its entirety.

In one embodiment, the anti-PD-1 antibody molecule includes at least one or two heavy chain variable domain (optionally including a constant region), at least one or two light chain variable domain (optionally including a constant region), or both, comprising the amino acid sequence of BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences. The anti-PD-1 antibody molecule, optionally, comprises a leader sequence from a heavy chain, a light chain, or both, as shown in Table 4 of US 2015/0210769; or a sequence substantially identical thereto.

In yet another embodiment, the anti-PD-1 antibody molecule includes at least one, two, or three complementarity determining regions (CDRs) from a heavy chain variable region and/or a light chain variable region of an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-1 antibody molecule includes at least one, two, or three CDRs (or collectively all of the CDRs) from a heavy chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-1 antibody molecule includes at least one, two, or three CDRs (or collectively all of the CDRs) from a light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-1 antibody molecule includes a substitution in a light chain CDR, e.g., one or more substitutions in a CDR1, CDR2 and/or CDR3 of the light chain. In one embodiment, the anti-PD-1 antibody molecule includes a substitution in the light chain CDR3 at position 102 of the light variable region, e.g., a substitution of a cysteine to tyrosine, or a cysteine to serine residue, at position 102 of the light variable region according to Table 1 (e.g., SEQ ID NO:16 or 24 for murine or chimeric, unmodified; or any of SEQ ID NOs:34, 42, 46, 54, 58, 62, 66, 70, 74, or 78 for a modified sequence).

In another embodiment, the anti-PD-1 antibody molecule includes at least one, two, three, four, five or six CDRs (or collectively all of the CDRs) from a heavy and light chain variable region comprising an amino acid sequence shown in Table 1 of US2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence of Table 1.

In one embodiment, the anti-PD-1 antibody molecule includes:

(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;

(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;

(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or (d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In other embodiments, the PD-1 inhibitor is an anti-PD-1 antibody chosen from nivolumab, pembrolizumab, or pidilizumab.

In some embodiments, the anti-PD-1 antibody is nivolumab. Alternative names for nivolumab include MDX-1106, MDX-1106-04, ONO-4538, or BMS-936558. In some embodiments, the anti-PD-1 antibody is nivolumab (CAS Registry Number: 946414-94-4). Nivolumab is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. In one embodiment, the inhibitor of PD-1 is nivolumab, and having a sequence disclosed herein (or a sequence substantially identical or similar thereto, e.g., a sequence at least 85%, 90%, 95% identical or higher to the sequence specified). In some embodiments, the anti-PD-1 antibody is pembrolizumab. Pembrolizumab (also referred to as lambrolizumab, MK-3475, MK03475, SCH-900475 or KEYTRUDA®; Merck) is a humanized IgG4 monoclonal antibody that binds to PD-1. Pembrolizumab and other humanized anti-PD-1 antibodies are disclosed in Hamid, O. et al. (2013) *New England Journal of Medicine* 369 (2): 134-44, U.S. Pat. No. 8,354,509 and WO2009/114335.

In one embodiment, the inhibitor of PD-1 is pembrolizumab disclosed in, e.g., U.S. Pat. No. 8,354,509 and WO 2009/114335, and having a sequence disclosed herein (or a sequence substantially identical or similar thereto, e.g., a sequence at least 85%, 90%, 95% identical or higher to the sequence specified).

In some embodiments, the anti-PD-1 antibody is pidilizumab. Pidilizumab (CT-011; Cure Tech) is a humanized IgG1k monoclonal antibody that binds to PD1. Pidilizumab and other humanized anti-PD-1 monoclonal antibodies are disclosed in U.S. Pat. No. 8,747,847 and WO2009/101611.

Other anti-PD1 antibodies include AMP 514 (Amplimmune), among others, e.g., anti-PD1 antibodies disclosed in U.S. Pat. No. 8,609,089, US 2010028330, and/or US 20120114649.

In some embodiments, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In some embodiments, the PD-1 inhibitor is AMP-224 (B7-DCIg; Amplimmune; e.g., disclosed in WO2010/027827 and WO2011/066342), is a PD-L2 Fc fusion soluble receptor that blocks the interaction between PD-1 and B7-H1.

In some embodiments, anti-PD-1 antibodies can be used in combination with a PD-1-targeted IL-15/Rα-Fc fusion protein of the invention. There are several anti-PD-1 antibodies including, but not limited to, two currently FDA approved antibodies, pembrolizumab and nivolizumab, as well as those in clinical testing currently, including, but not limited to, tislelizumab, Sym021, REGN2810 (developed by Rengeneron), JNJ-63723283 (developed by J and J), SHR-1210, pidilizumab, AMP-224, MEDIo680, PDR001 and CT-001, as well as others outlined in Liu et al., J. Hemat. & Oncol. (2017)10:136, the antibodies therein expressly incorporated by reference.

In some embodiments, a PD-1-targeted IL-15/Rα-Fc fusion protein described herein can be used in combination with a PD-1 inhibitor (e.g., an anti-PD-1 antibody). In certain embodiments, a PD-1-targeted IL-15/Rα-Fc fusion protein (e.g., XENP25937 and XENP25850) described herein is administered in combination with an anti-PD-1 antibody.

B. Anti-TIM3 Antibodies

Exemplary non-limiting anti-TIM-3 antibody molecules are disclosed in US 2015/0218274, published on Aug. 6, 2015, entitled "Antibody Molecules to TIM-3 and Uses Thereof," incorporated by reference in its entirety.

In one embodiment, the anti-TIM-3 antibody molecule includes at least one or two heavy chain variable domain (optionally including a constant region), at least one or two light chain variable domain (optionally including a constant region), or both, comprising the amino acid sequence of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. The anti-TIM-3 antibody molecule, optionally, comprises a leader sequence from a heavy chain, a light chain, or both, as shown in US 2015/0218274; or a sequence substantially identical thereto.

In yet another embodiment, the anti-TIM-3 antibody molecule includes at least one, two, or three complementarity determining regions (CDRs) from a heavy chain variable region and/or a light chain variable region of an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In yet another embodiment, the anti-TIM-3 antibody molecule includes at least one, two, or three CDRs (or collectively all of the CDRs) from a heavy chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Table 1-4.

In yet another embodiment, the anti-TIM-3 antibody molecule includes at least one, two, or three CDRs (or collectively all of the CDRs) from a light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4. In certain embodiments, the anti-TIM-3 antibody molecule includes a substitution in a light chain CDR, e.g., one or more substitutions in a CDR1, CDR2 and/or CDR3 of the light chain.

In another embodiment, the anti-TIM-3 antibody molecule includes at least one, two, three, four, five or six CDRs (or collectively all of the CDRs) from a heavy and light chain variable region comprising an amino acid sequence shown in Tables 1-4 of US 2015/0218274, or encoded by a nucleotide sequence shown in Tables 1-4. In one embodiment, one or more of the CDRs (or collectively all of the CDRs) have one, two, three, four, five, six or more changes, e.g., amino acid substitutions or deletions, relative to the amino acid sequence shown in Tables 1-4, or encoded by a nucleotide sequence shown in Tables 1-4.

In one embodiment, the anti-TIM-3 antibody molecule includes:
(a) a heavy chain variable region (VH) comprising a VHCDR1 amino acid sequence chosen from SEQ ID NO: 9; a VHCDR2 amino acid sequence of SEQ ID NO: 10; and a VHCDR3 amino acid sequence of SEQ ID NO: 5; and a light chain variable region (VL) comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;
(b) a VH comprising a VHCDR1 amino acid sequence chosen from SEQ ID NO: 3; a VHCDR2 amino acid sequence of SEQ ID NO: 4; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;
(c) a VH comprising a VHCDR1 amino acid sequence chosen from SEQ ID NO: 9; a VHCDR2 amino acid sequence of SEQ ID NO: 25; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;
(d) a VH comprising a VHCDR1 amino acid sequence chosen from SEQ ID NO: 3; a VHCDR2 amino acid sequence of SEQ ID NO: 24; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;
(e) a VH comprising a VHCDR1 amino acid sequence chosen from SEQ ID NO: 9; a VHCDR2 amino acid sequence of SEQ ID NO: 31; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274; or
(f) a VH comprising a VHCDR1 amino acid sequence chosen from SEQ ID NO: 3; a VHCDR2 amino acid sequence of SEQ ID NO: 30; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274.

Exemplary anti-TIM-3 antibodies are disclosed in U.S. Pat. No. 8,552,156, WO 2011/155607, EP 2581113 and U.S. Publication No.: 2014/044728.

In some embodiments, anti-TIM-3 antibodies can be used in combination with a PD-1-targeted IL-15/Rα-Fc fusion protein of the invention. There are several TIM-3 antibodies in clinical development, including, but not limited to, MBG453 and TSR-022.

In some embodiments, a PD-1-targeted IL-15/Rα-Fc fusion protein described herein can be used in combination with a TIM-3 inhibitor (e.g., an anti-TIM3 antibody). In certain embodiments, a PD-1-targeted IL-15/Rα-Fc fusion protein (e.g., XENP25937 and XENP25850) described herein is administered in combination with an anti-TIM3 antibody.

C. Anti-CTLA4 Antibodies

Exemplary anti-CTLA4 antibodies include tremelimumab (IgG2 monoclonal antibody available from Pfizer, formerly known as ticilimumab, CP-675,206); and dim (CTLA-4 antibody, also known as MDX-010, CAS No. 477202-00-9). Other exemplary anti-CTLA-4 antibodies are disclosed, e.g., in U.S. Pat. No. 5,811,097.

In one embodiment, the anti-CTLA4 antibody is ipilimumab disclosed in, e.g., U.S. Pat. Nos. 5,811,097, 7,605,238, WO00/32231 and WO97/20574, and having a sequence disclosed herein (or a sequence substantially identical or similar thereto, e.g., a sequence at least 85%, 90%, 95% identical or higher to the sequence specified).

In one embodiment, the anti-CTLA4 antibody is tremelimumab disclosed in, e.g., U.S. Pat. No. 6,682,736 and WO00/37504, and having a sequence disclosed herein (or a sequence substantially identical or similar thereto, e.g., a sequence at least 85%, 90%, 95% identical or higher to the sequence specified).

In some embodiments, anti-CTLA-4 antibodies can be used in combination with a PD-1-targeted IL-15/Rα-Fc fusion protein of the invention. Thus, suitable anti-CTLA-4 antibodies for use in combination therapies as outlined herein include, but are not limited to, one currently FDA approved antibody ipilimumab, and several more in development, including CP-675,206 and AGEN-1884.

In some embodiments, PD-1-targeted IL-15/Rα-Fc fusion protein described herein can be used in combination with a CTLA-4 inhibitor (e.g., an anti-CTLA-4 antibody). In certain embodiments, a PD-1-targeted IL-15/Rα-Fc fusion protein (e.g., XENP25937 and XENP25850) described herein is administered in combination with an anti-CTLA-4 antibody.

D. Anti-PD-L1 Antibodies

Exemplary non-limiting anti-PD-L1 antibody molecules are disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three complementarity determining regions (CDRs) from a heavy chain variable region and/or a light chain variable region of an antibody described herein, e.g., an antibody chosen from any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three CDRs (or collectively all of the CDRs) from a heavy chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one, two, or three CDRs (or collectively all of the CDRs) from a light chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-PD-L1 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-L1 antibody molecule includes:
  (i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of US 2016/0108123; and
  (ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US 2016/0108123.

In another embodiment, the anti-PD-L1 antibody molecule includes:
  (i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US 2016/0108123; and
  (ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US 2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US 2016/0108123.

In some embodiments, the PD-L1 inhibitor is an antibody molecule. In some embodiments, the anti-PD-L1 inhibitor is chosen from YW243.55.S70, MPDL3280A, MEDI-4736, MSB-0010718C, MDX-1105, atezolizumab, durbalumab, avelumab, or BMS936559.

In some embodiments, the anti-PD-L1 antibody is atezolizumab. Atezolizumab (also referred to as MPDL3280A and Atezo®; Roche) is a monoclonal antibody that binds to PD-L1. Atezolizumab and other humanized anti-PD-L1 antibodies are disclosed in U.S. Pat. No. 8,217,149, and having a sequence disclosed herein (or a sequence substantially identical or similar thereto, e.g., a sequence at least 85%, 90%, 95% identical or higher to the sequence specified).

In some embodiments, the anti-PD-L1 antibody is avelumab. Avelumab (also referred to as A09-246-2; Merck Serono) is a monoclonal antibody that binds to PD-L1. Avelumab and other humanized anti-PD-L1 antibodies are disclosed in U.S. Pat. No. 9,324,298 and WO2013/079174, and having a sequence disclosed herein (or a sequence substantially identical or similar thereto, e.g., a sequence at least 85%, 90%, 95% identical or higher to the sequence specified).

In some embodiments, the anti-PD-L1 antibody is durvalumab. Durvalumab (also referred to as MEDI4736; AstraZeneca) is a monoclonal antibody that binds to PD-L1. Durvalumab and other humanized anti-PD-L1 antibodies are disclosed in U.S. Pat. No. 8,779,108, and having a sequence disclosed herein (or a sequence substantially identical or similar thereto, e.g., a sequence at least 85%, 90%, 95% identical or higher to the sequence specified).

In some embodiments, the anti-PD-L1 antibody is BMS-936559. BMS-936559 (also referred to as MDX-1105; BMS) is a monoclonal antibody that binds to PD-L1. BMS-936559 and other humanized anti-PD-L1 antibodies are disclosed in U.S. Pat. No. 7,943,743 and WO2007005874, and having a sequence disclosed herein (or a sequence substantially identical or similar thereto, e.g., a sequence at least 85%, 90%, 95% identical or higher to the sequence specified).

In some embodiments, anti-PD-L1 antibodies can be used in combination with an PD-1-targeted IL-15/Rα-Fc fusion protein of the invention. There are several anti-PD-L1 antibodies including three currently FDA approved antibodies, atezolizumab, avelumab, durvalumab, as well as those in clinical testing currently, including, but not limited to, LY33000054 and CS1001, as well as others outlined in Liu et al., J. Hemat. & Oncol. (2017)10:136, the antibodies therein expressly incorporated by reference.

In some embodiments, an PD-1-targeted IL-15/Rα-Fc fusion protein described herein can be used in combination with a PD-L1 inhibitor (e.g., an anti-PD-L1 antibody). In certain embodiments, an PD-1-targeted IL-15/Rα-Fc fusion protein (e.g., XENP25937 and XENP25850) described herein is administered in combination with an anti-PD-L1 antibody.

In some embodiments, an PD-1-targeted IL-15/Rα-Fc fusion protein described herein can be used in combination with a PD-L1 or PD-L2 inhibitor (e.g., an anti-PD-L1 antibody).

E. Anti-TIGIT Antibodies

In some embodiments, the anti-TIGIT antibody is OMP-313M32. OMP-313M32 (OncoMed Pharmaceuticals) is a monoclonal antibody that binds to TIGIT. OMP-313M32 and other humanized anti-TIGIT antibodies are disclosed in US20160376365 and WO2016191643, and having a sequence disclosed herein (or a sequence substantially identical or similar thereto, e.g., a sequence at least 85%, 90%, 95% identical or higher to the sequence specified).

In some embodiments, the anti-TIGIT antibody is BMS-986207. BMS-986207 (also referred to as ONO-4686; Bristol-Myers Squibb) is a monoclonal antibody that binds to TIGIT. BMS-986207 and other humanized anti-TIGIT antibodies are disclosed in US20160176963 and WO2016106302, and having a sequence disclosed herein (or a sequence substantially identical or similar thereto, e.g., a sequence at least 85%, 90%, 95% identical or higher to the sequence specified).

In some embodiments, the anti-TIGIT antibody is MTIG7192. MTIG7192 (Genentech) is a monoclonal antibody that binds to TIGIT. MTIG7192 and other humanized anti-TIGIT antibodies are disclosed in US2017088613, WO2017053748, and WO2016011264, and having a sequence disclosed herein (or a sequence substantially identical or similar thereto, e.g., a sequence at least 85%, 90%, 95% identical or higher to the sequence specified).

In some embodiments, anti-TIGIT antibodies can be used in combination with an PD-1-targeted IL-15/Rα-Fc fusion protein of the invention. There are several TIGIT antibodies in clinical development, BMS-986207, OMP-313M32 and MTIG7192A.

In some embodiments, an PD-1-targeted IL-15/Rα-Fc fusion protein described herein can be used in combination with a TIGIT inhibitor (e.g., an anti-TIGIT antibody). In certain embodiments, an PD-1-targeted IL-15/Rα-Fc fusion protein (e.g., XENP25937 and XENP25850) described herein is administered in combination with an anti-TIGIT antibody.

F. Anti-LAG-3 Antibodies

Exemplary non-limiting anti-LAG-3 antibody molecules are disclosed in US 2015/0259420 published on Sep. 17, 2015, entitled "Antibody Molecules to LAG-3 and Uses Thereof," incorporated by reference in its entirety.

In one embodiment, the anti-LAG-3 antibody molecule includes at least one or two heavy chain variable domain (optionally including a constant region), at least one or two light chain variable domain (optionally including a constant region), or both, comprising the amino acid sequence of any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three complementarity determining regions (CDRs) from a heavy chain variable region and/or a light chain variable region of an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three CDRs (or collectively all of the CDRs) from a heavy chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-LAG-3 antibody molecule includes at least one, two, or three CDRs (or collectively all of the CDRs) from a light chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-LAG-3 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2015/0259420. In one embodiment, one or more of the CDRs (or collectively all of the CDRs)

have one, two, three, four, five, six or more changes, e.g., amino acid substitutions or deletions, relative to the amino acid sequence shown in Table 1, or encoded by a nucleotide sequence shown in Table 1.

In one embodiment, the anti-LAG-3 antibody molecule includes:
(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 2; and a VHCDR3 amino acid sequence of SEQ ID NO: 3, each disclosed in Table 1 of US 2015/0259420; and
(ii) a light chain variable region (VL) including a VLCDR1 amino acid sequence of SEQ ID NO: 10, a VLCDR2 amino acid sequence of SEQ ID NO: 11, and a VLCDR3 amino acid sequence of SEQ ID NO: 12, each disclosed in Table 1 of US 2015/0259420.

In another embodiment, the anti-LAG-3 antibody molecule includes:
(i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 5, and a VHCDR3 amino acid sequence of SEQ ID NO: 3, each disclosed in Table 1 of US 2015/0259420; and
(ii) a light chain variable region (VL) including a VLCDR1 amino acid sequence of SEQ ID NO: 13, a VLCDR2 amino acid sequence of SEQ ID NO: 14, and a VLCDR3 amino acid sequence of SEQ ID NO: 15, each disclosed in Table 1 of US 2015/0259420.

In one embodiment, the anti-LAG-3 antibody molecule comprises the VHCDR1 amino acid sequence of SEQ ID NO: 1. In another embodiment, the anti-LAG-3 antibody molecule comprises the VHCDR1 amino acid sequence of SEQ ID NO: 4. In yet another embodiment, the anti-LAG-3 antibody molecule comprises the VHCDR1 amino acid sequence of SEQ ID NO: 286, each disclosed in Table 1 of US 2015/0259420.

In some embodiments, the anti-LAG-3 antibody is BMS-986016. BMS-986016 (also referred to as BMS986016; Bristol-Myers Squibb) is a monoclonal antibody that binds to LAG-3. BMS-986016 and other humanized anti-LAG-3 antibodies are disclosed in US 2011/0150892, WO2010/019570, and WO2014/008218.

In some embodiments, the anti-LAG3 antibody is LAG525. LAG525 (also referred to as IMP701; Novartis) is a monoclonal antibody that binds to LAG3. LAG525 and other humanized anti-LAG3 antibodies are disclosed in U.S. Pat. No. 9,244,059 and WO2008132601, and having a sequence disclosed herein (or a sequence substantially identical or similar thereto, e.g., a sequence at least 85%, 90%, 95% identical or higher to the sequence specified).

Other exemplary anti-LAG-3 antibodies are disclosed, e.g., in US2011150892 and US2018066054.

In some embodiments, anti-LAG-3 antibodies can be used in combination with a PD-1-targeted IL-15/Rα-Fc fusion protein of the invention. There are several anti-LAG-3 antibodies in clinical development including REGN3767, by Regeneron and TSR-033 (Tesaro).

In some embodiments, a PD-1-targeted IL-15/Rα-Fc fusion protein described herein can be used in combination with a LAG-inhibitor (e.g., an anti-LAG-3 antibody). In certain embodiments, an PD-1-targeted IL-15/Rα-Fc fusion protein (e.g., XENP25937 and XENP25850) described herein is administered in combination with an anti-LAG3 antibody.

XIII. Combination Therapy

In some aspects, the PD-1-targeted IL-15/Rα-Fc fusion proteins described herein is administered in combination with another therapeutic agent. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The PD-1-targeted IL-15/Rα-Fc fusion protein (such as but not limited to XENP25937 and XENP25850) described herein and the at least one additional therapeutic agent can be administered simultaneously, in the same or in separate compositions, or sequentially. For sequential administration, the PD-1-targeted IL-15/Rα-Fc fusion protein described herein can be administered first, and the additional agent can be administered second, or the order of administration can be reversed.

The PD-1-targeted IL-15/Rα-Fc fusion protein described herein and/or other therapeutic agents, procedures or modalities can be administered during periods of active disorder, or during a period of remission or less active disease. The PD-1-targeted IL-15/Rα-Fc fusion protein can be administered before the other treatment, concurrently with the treatment, post-treatment, or during remission of the disorder.

When administered in combination, the PD-1-targeted IL-15/Rα-Fc fusion protein (such as, but not limited to, XENP25937 and XENP25850) and the additional agent (e.g., second or third agent), or all, can be administered in an amount or dose that is lower or the same than the amount or dosage of each agent used individually, e.g., as a monotherapy. In some embodiments, the administered amount or dosage of PD-1-targeted IL-15/Rα-Fc fusion protein, the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the PD-1-targeted IL-15/Rα-Fc fusion protein, the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, a PD-1-targeted IL-15/Rα-Fc fusion protein (such as, but not limited to, XENP25937 and XENP25850) described herein may be used in a treatment regimen in combination with chemotherapy, radiation, immunosuppressive agents, such as cyclosporin, azathioprine, methotrexate, mycophenolate, and FK506, antibodies directed against checkpoint inhibitors, or other immunoablative agents such as CAMPATH, other antibody therapies, cytoxan, fludarabine, cyclosporin, FK506, rapamycin, mycophenolic acid, steroids, FR90165, cytokines, and irradiation. peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, a PD-1-targeted IL-15/Rα-Fc fusion protein (such as, but not limited to, XENP25937 and XENP25850) described herein can be used in combination with a chemotherapeutic agent. Exemplary chemotherapeutic agents include an anthracycline (e.g., idarubicin, daunorubicin, doxorubicin (e.g., liposomal doxorubicin)), an anthracenedione derivative (e.g., mitoxantrone), a *vinca* alkaloid (e.g., vinblastine, vincristine, vindesine, vinorelbine), an alkylating agent (e.g., cyclophosphamide, dacarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, cytarabine, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), a kinase inhibitor such as ibrutinib (e.g., Imbruvica), a corticosteroid (e.g., dexamethasone, prednisone), and CVP (a combination of cyclophosphamide, vincristine, and prednisone), CHOP (a combination of cyclophosphamide, hydroxydaunorubicin, Oncovin® (vincristine), and prednisone) with or without etoposide (e.g., VP-16), a combination of cyclophosphamide and pentostatin, a combination of chlorambucil and prednisone, a combination of fludarabine and cyclophosphamide, or another agent such as mechlorethamine hydrochloride (e.g. Mustargen), doxorubicin (Adriamycin®), methotrexate, oxaliplatin, or cytarabine (ara-C).

General chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

XIV. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the PD-1-targeted IL-15/Rα-Fc fusion protein compositions of the invention find use in the treatment of these cancers.

A. PD-1-Targeted IL-15/Rα-Fc Fusion Proteins Compositions for In Vivo Administration Formulations of the antibodies used in accordance with the present invention are prepared for storage by mixing an antibody having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g., Zn-protein complexes); and/or non-ionic surfactants such as TWEEN™, PLURONICS™ or polyethylene glycol (PEG).

B. Administrative Modalities

The PD-1-targeted IL-15/Rα-Fc fusion proteins disclosed herein and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the antibody or antibody portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the PD-1-targeted IL-15/Rα-Fc fusion proteins used in the present invention depend on the disease or condition to be treated and may be determined by the persons skilled in the art.

An exemplary, non-limiting range for a therapeutically effective amount of an PD-1-targeted IL-15/Rα-Fc fusion protein used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Publications 2015/0307629, 2014/0288275 and WO2014/145806, all of which are expressly incorporated by reference in their entirety and particularly for the techniques outlined therein. Examples 1 and 2 from U.S. Ser. No. 62/416,087, filed on Nov. 1, 2016 are expressly incorporated by reference in their entirety, including the corresponding figures.

XV. Example 1: Anti-PD-1 ABDs

A. 1A: Illustrative Anti-PD-1 ABDs

Examples of antigen-binding domains which bind PD-1 were described in WO 2017/218707, herein incorporated by reference, for example, illustrative sequences of variable domains for which are depicted in FIG. 14. Additional non-limiting examples of PD-1 ABDs which may find use in the PD-1-targeted IL-15/Rα-Fc fusion proteins of the invention are depicted in FIG. 15.

B. 1B: Generation of Anti-PD-1 Clone 1C11

1. 1B(a): Generation and Screening of Anti-PD-1 Hybridoma

To develop additional PD-1 targeting arms PD-1 targeted IL-15/Rα-Fc fusion proteins of the invention, monoclonal antibodies were first generated by hybridoma technology through ImmunoPrecise Antibodies Ltd., through their Standard Method and Rapid Prime Method. For the Standard Method, antigen(s) was injected into 3 BALB/c mice. 7-10 days before being sacrificed for hybridoma generation, the immunized mice received an antigen boost. Antibody titer was evaluated by ELISA on the antigen and the best responding mice are chosen for fusion. A final antigen boost was given 4 days prior to fusion. Lymphocytes from the mice were pooled, purified then fused with SP2/0 myeloma cells. Fused cells were grown on HAT selective Single-Step cloning media for 10-12 days at which point the hybridomas were ready for screening. For the Rapid Prime method, antigen(s) was injected into 3 BALB/c mice. After 19 days, lymphocytes from all the mice were pooled, purified then fused with SP2/0 myeloma cells. Fused cells were grown on HAT selective Single-Step cloning media for 10-12 days at which point the hybridomas were ready for screening. Antigen(s) used were mouse Fc fusion of human PD-1 (huPD-1-mFc), mouse Fc fusion of cyno PD-1 (cynoPD-1-mFc), His-tagged human PD-1 (huPD-1-His), His-tagged cyno PD-1 (cynoPD-1-His) or mixtures thereof.

Anti-PD-1 hybridoma clones generated as described above were subject to two rounds of screening using Octet, a BioLayer Interferometry (BLI)-based method. Experimental steps for Octet generally included the following: Immobilization (capture of ligand or test article onto a biosensor); Association (dipping of ligand- or test article-coated biosensors into wells containing serial dilutions of the corresponding test article or ligand); and Dissociation (returning of biosensors to well containing buffer) in order to determine the affinity of the test articles. A reference well containing buffer alone was also included in the method for background correction during data processing.

For the first round, anti-mouse Fc (AMC) biosensors were used to capture the clones with dips into 500 nM of bivalent human and cyno PD-1-Fc-His. For the second round, clones identified in the first round that were positive for both human and cyno PD-1 were captured onto AMC biosensors and dipped into 500 nM monovalent human and cyno PD-1-His.

2. 1B(b): Characterization of Clone 1C11

One hybridoma clone identified in Example 1B(a) was clone 1C11. DNA encoding the VH and VL of hybridoma clone 1C11 were generated by gene synthesis and subcloned using standard molecular biology techniques into expression vector pTT5 containing human IgG1 constant region with E233P/L234V/L235A/G236del/S267K substitutions to generate XENP21575, sequences for which are depicted in FIG. 16.

1B(b)(i): PD-L1 Blocking with Clone 1C11

Blocking of checkpoint receptor/ligand interaction is necessary for T cell activation. The blocking ability of XENP21575 was investigated in a cell binding assay. HEK293T cells transfected to express PD-1 were incubated with XENP21575, as well as control antibodies. Following incubation, a murine Fc fusion of PD-L1 was added and allowed to incubate. Binding of PD-L1-mFc to HEK293T cells was detected with an anti-murine IgG secondary antibody, data for which are depicted in FIG. 17.

1B(b)(ii): T Cell Surface Binding of Clone 1C11

Binding of anti-PD-1 clone 1C11 to T cells was measured in an SEB-stimulated PBMC assay. Staphylococcal Enterotoxin B (SEB) is a superantigen that causes T cell activation and proliferation in a manner similar to that achieved by activation via the T cell receptor (TCR), including expression of checkpoint receptors such as PD-1. Human PBMCs were stimulated with 100 ng/mL for 3 days. Following stimulation, PBMCs were incubated with the indicated test articles at indicated concentrations at 4° C. for 30 min. PBMCs were stained with anti-CD3-FITC (UCHT1) and APC labeled antibody for human immunoglobulin κ light chain. The binding of the test articles to T cells as indicated by APC MFI on FITC+ cells is depicted in FIG. 18.

1B(b)(iii): T Cell Activation by Clone 1C11

T cell activation by clone 1C11, as indicated by cytokine secretion, was investigated in an SEB-stimulated PBMC assay. Human PBMCs were stimulated with 500 ng/mL SEB for 2 days. Cells were then washed twice in culture medium and stimulated with 500 ng/mL SEB in combination with indicated amounts of indicated test articles for 24 hours. Supernatants were then assayed for IL-2 and IFNγ by cells, data for which are depicted in FIGS. 19A-19B.

3. 1B(c): Humanization of Clone 1C11

Clone 1C11 humanized using string content optimization (see, e.g., U.S. Pat. No. 7,657,380, issued on Feb. 2, 2010). DNA encoding the heavy and light chains were generated by gene synthesis and subcloned using standard molecular biology techniques into the expression vector pTT5. Sequences for illustrative humanized variants of clone 1C11 in bivalent antibody format are depicted in FIGS. 20A-20C.

The affinity of XENP22553 was determined using Octet as generally described in Example 1B(a). In particular, anti-human Fc (AHC) biosensors were used to capture the test article with dips into multiple concentrations of histidine-tagged PD-1. The affinity result and corresponding sensorgram are depicted in FIG. 21.

XVI. Example 2: IL-15/Rα-Fc

A. 2A: Engineering IL-15 Rα-Fc Fusion Proteins

In order to address the short half-life of IL-15/IL-15Rα heterodimers, we generated the IL-15/IL-15Rα(sushi) complex as a Fc fusion (hereon referred to as "IL-15/Rα-Fc fusion proteins") with the goal of facilitating production and promoting FcRn-mediated recycling of the complex and prolonging half-life.

Plasmids coding for IL-15 or IL-15Rα sushi domain were constructed by standard gene synthesis, followed by subcloning into a pTT5 expression vector containing Fc fusion partners (e.g., constant regions as depicted in FIG. 8A-FIG. 8F). Cartoon schematics of illustrative IL-15/Rα-Fc fusion protein formats are depicted in FIG. 22A-22 Figure G.

Illustrative proteins of the IL-15/Rα-heteroFc format (FIG. 22A) include XENP20818 and XENP21475, sequences for which are depicted in FIG. 23. An illustrative proteins of the scIL-15/Rα-Fc format (FIG. 22B) is XENP21478, sequences for which are depicted in FIG. 24. Illustrative proteins of the ncIL-15/Rα-Fc format (FIG. 22C) include XENP21479, XENP22366, and XENP24348 sequences for which are depicted in FIGS. 25A-25B. An illustrative protein of the bivalent ncIL-15/Rα-Fc format (FIG. 22D) is XENP21978, sequences for which are depicted in FIG. 26. Sequences for an illustrative protein of the bivalent scIL-15/Rα-Fc format (FIG. 22E) are depicted in FIG. 27. An illustrative protein of the Fc-ncIL-15/Rα format (FIG. 22F) is XENP22637, sequences for which are depicted in FIG. 28. Sequences for an illustrative protein of the Fc-scIL-15/Rα format (FIG. 22G) are depicted in FIG. 29.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

IL-15/Rα-Fc fusion proteins in the various formats as described above were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cy5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cell proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIGS. 30A-30C and 31A-31C). The various IL-15/Rα-Fc fusion proteins induced strong proliferation of CD8+ T cells and NK cells. Notably, differences in proliferative activity were dependent on the linker length on the IL-15-Fc side. In particular, constructs having no linker (hinge only), including XENP21471, XENP21474, and XENP21475, demonstrated weaker proliferative activity.

B. 2B: IL-15/Rα-Fc Fusion Proteins with Engineered Disulfide Bonds

To further improve stability and prolong the half-life of IL-15/Rα-Fc fusion proteins, we engineered disulfide bonds into the IL-15/Rα interface. By examining the crystal structure of the IL-15/Rα complex, as well as by modeling using Molecular Operating Environment (MOE; Chemical Computing Group, Montreal, Quebec, Canada) software, we predicted residues at the IL-15/Rα interface that may be substituted with cysteine in order to form covalent disulfide bonds, as depicted in FIG. 32. Additionally, up to three amino acids following the sushi domain in IL-15Rα were added to the C-terminus of IL-15Rα(sushi) as a scaffold for engineering cysteines (illustrative sequences for which are depicted in FIG. 33). Sequences for illustrative IL-15 and IL-15Rα(sushi) variants engineered with cysteines are respectively depicted in FIG. 34 and FIG. 35.

Plasmids coding for IL-15 or IL-15Rα(sushi) were constructed by standard gene synthesis, followed by subcloning into a pTT5 expression vector containing Fc fusion partners (e.g., constant regions as depicted in FIGS. 11A-11C). Residues identified as described above were substituted with cysteines by standard mutagenesis techniques. Cartoon schematics of IL-15/Rα-Fc fusion proteins with engineered disulfide bonds are depicted in FIG. 36A-FIG. 36D.

Illustrative proteins of the dsIL-15/Rα-heteroFc format (FIG. 36A) include XENP22013, XENP22014, XENP22015, and XENP22017, sequences for which are depicted in FIG. 37A-37B. Illustrative proteins of the dsIL-15/Rα-Fc format (FIG. 36B) include XENP22357, XENP22358, XENP22359, XENP22684, and XENP22361, sequences for which are depicted in FIGS. 38A-38B. Illustrative protein of the bivalent dsIL-15/Rα-Fc format (FIG. 36C) include XENP22634, XENP22635, and XENP22636, sequences for which are depicted in FIG. 39. Illustrative proteins of the Fc-dsIL-15/Rα format (FIG. 36D) include XENP22639 and XENP22640, sequences for which are depicted in FIG. 40.

Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

After the proteins were purified, they were characterized by capillary isoelectric focusing (CEF) for purity and homogeneity. CEF was performed using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Many of the disulfide bonds were correctly formed as indicated by denaturing non-reducing CEF, where the larger molecular weight of the covalent complex can be seen when compared to the controls without engineered disulfide bonds (FIG. 41).

The proteins were then tested in a cell proliferation assay. IL-15/Rα-Fc fusion proteins (with or without engineered disulfide bonds) or controls were incubated with PBMCs for 4 days. Following incubation, PBMCs were stained with anti-CD4-PerCP/Cγ5.5 (RPA-T4), anti-CD8-FITC (RPA-T8), anti-CD45RA-BV510 (HI100), anti-CD16-BV421 (3G8), anti-CD56-BV421 (HCD56), anti-CD27-PE (O323), and anti-Ki67-APC (Ki-67) to mark various cell populations and analyzed by FACS as generally described in Example 2A. Proliferation of NK cells, CD4+ T cells, and CD8+ T cells as indicated by Ki67 expression are depicted in FIGS. 42A-42C. Each of the IL-15/Rα-Fc fusion proteins and the IL-15 control induced strong proliferation of NK cells, CD8+ T cells, and CD4+ T cells.

C. 2C: IL-15/Rα-Fc Fusion Proteins Engineered for Lower Potency and Increased PK and Half-Life In order to further improve PK and prolong half-life, we reasoned that decreasing the potency of IL-15 would decrease the antigen sink, and thus, increase the half-life. By examining the crystal structure of the IL-15:IL-2Rβ and IL-15:common gamma chain interfaces, as well as by modeling using MOE software, we predicted residues at these interfaces that may be substituted in order to reduce potency. FIG. 43 depicts a structural model of the IL-15:receptor complexes showing locations of the predicted residues where we engineered isosteric substitutions (in order to reduce the risk of immunogenicity). Sequences for illustrative IL-15 variants engineered for reduced potency are depicted in FIG. 44A-FIG. 44C.

Plasmids coding for IL-15 or IL-15Rα(sushi) were constructed by standard gene synthesis, followed by subcloning into a pTT5 expression vector containing Fc fusion partners (e.g., constant regions as depicted in FIG. 11). Substitutions identified as described above were incorporated by standard mutagenesis techniques. Sequences for illustrative IL-15/Rα-Fc fusion proteins of the "IL-15/Rα-heteroFc" format engineered for reduced potency are depicted in FIG. 45A-FIG. 45D. Sequences for illustrative IL-15/Rα-Fc fusion proteins of the "scIL-15/Rα-Fc" format engineered for reduced potency are depicted in FIGS. 46A-46C. Sequences for illustrative IL-15/Rα-Fc fusion proteins of the "ncIL-15/Rα-Fc" format engineered for reduced potency are depicted in FIG. 47A-FIG. 47B. Sequences for illustrative ncIL-15/Rα heterodimers engineered for reduced potency are depicted in FIG. 48. Sequences for an illustrative IL-15/Rα-Fc fusion protein of the "bivalent ncIL-15/Rα-Fc" format engineered for reduced potency are depicted in FIG. 49. Sequences for illustrative IL-15/Rα-Fc fusion proteins of the "dsIL-15/Rα-Fc" format engineered for reduced potency are depicted in FIG. 50. Proteins were produced by transient transfection in HEK293E cells and were purified by a two-step purification process comprising protein A chromatography (GE Healthcare) and anion exchange chromatography (HiTrapQ 5 mL column with a 5-40% gradient of 50 mM Tris pH 8.5 and 50 mM Tris pH 8.5 with 1 M NaCl).

D. 2C(a): In Vitro Activity of Variant IL-15/Rα-Fc Fusion Proteins Engineered for Decreased Potency The variant IL-15/Rα-Fc fusion proteins were tested in a number of cell proliferation assays.

In a first cell proliferation assay, IL-15/Rα-Fc fusion proteins (with or without engineered substitutions) or control were incubated with PBMCs for 4 days. Following incubation, PBMCs were stained with anti-CD4-Evolve605 (SK-3), anti-CD8-PerCP/Cγ5.5 (RPA-T8), anti-CD45RA-APC/Cγ7 (HI100), anti-CD16-eFluor450 (CB16), anti- CD56-eFluor450 (TULY56), anti-CD3-FITC (OKT3), and anti-Ki67-APC (Ki-67) to mark various cell populations and analyzed by FACS as generally described in Example 2A. Proliferation of NK cells, CD8+ T cells, and CD4+ T cells as indicated by Ki67 expression are depicted in FIG. 51A-FIGS. 51C and 52. Most of the IL-15/Rα-Fc fusion proteins induced proliferation of each cell population; however, activity varied depending on the particular engineered substitutions.

In a second cell proliferation assay, IL-15/Rα-Fc fusion proteins (with or without engineered substitutions) were incubated with PBMCs for 3 days. Following incubation, PBMCs were stained with anti-CD3-FITC (OKT3), anti-CD4-Evolve604 (SK-3), anti-CD8-PerCP/Cγ5.5 (RPA-T8), anti-CD16-eFluor450 (CB16), anti-CD56-eFluor450 (TULY56), anti-CD27-PE (0323), anti-CD45RA-APC/Cγ7 (HI100) and anti-Ki67-APC (20Raj1) antibodies to mark various cell populations. FIGS. 53A-53C and 54A-54C depict selection of various cell populations following incubation with XENP22821 by FACS. Lymphocytes were first gated on the basis of side scatter (SSC) and forward scatter (FSC) (FIG. 53A). Lymphocytes were then gated based on CD3 expression (FIG. 53B). Cells negative for CD3 expression were further gated based on CD16 expression to identify NK cells (CD16+) (FIG. 53C). CD3+ T cells were further gated based on CD4 and CD8 expression to identify CD4+ T cells, CD8+ T cells, and γδ T cells (CD3+CD4−CD8−) (FIG. 54A). The CD4+ and CD8+ T cells were gated for CD45RA expression as shown respectively in FIG. 54B-FIG. 54C. Finally, the proliferation of the various cell populations were determined based on percentage Ki67 expression, and the data are shown in FIG. 56A-FIG. 56D. NK and CD8+ T cells are more sensitive than CD4+ T cells to IL-15/Rα-Fc fusion proteins, and as above, proliferative activity varied depending on the particular engineered substitutions. FIG. 56D shows the fold change in EC50 of various IL-15/Rα-Fc fusion proteins relative to control XENP20818. FIGS. 55A and B further depict the activation of lymphocytes following treatment with IL-15/Rα-Fc fusion proteins by gating for the expression of CD69 and CD25 (T cell activation markers) before and after incubation of PBMCs with XENP22821.

In a third experiment, additional variant IL-15/Rα-Fc fusion proteins were incubated with human PBMCs for 3 days at 37° C. Following incubation, PBMCs were stained with anti-CD3-FITC (OKT3), anti-CD4-SB600 (SK-3), anti-CD8-PerCP/Cγ5.5 (RPA-T8), anti-CD45RA-APC/Cγ7 (HI100), anti-CD16-eFluor450 (CB16), anti-CD25-PE (M-A251), and anti-Ki67-APC (Ki-67) to mark various cell populations and analyzed by FACS as generally described in Example 2A. Proliferation of CD8+ (CD45RA−) T cells, CD4+ (CD45RA−) T cells, γδ T cells, and NK cells as indicated by Ki67 expression are depicted in FIG. 57A-FIG. 57D.

In a fourth experiment, human PBMCs were incubated with the additional IL-15/Rα-Fc variants at the indicated concentrations for 3 days. Following incubation, PBMCs were stained with anti-CD3-FITC (OKT3), anti-CD4 (SB600), anti-CD8-PerCP/Cγ5.5 (RPA-T8), anti-CD16-eFluor450 (CB16), anti-CD25-PE (M-A251), anti-CD45RA-APC/Cγ7 (HI100), and anti-Ki67-APC (Ki67) and analyzed by FACS as generally described in Example 2A. Percentage of Ki67 on CD8+ T cells, CD4+ T cells and NK cells following treatment are depicted in FIG. 58A-FIG. 58C.

In a fifth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SKI), anti-CD8β-APC (2ST8.5H7), anti-CD16-BV421 (3G8), anti-CD25-PerCP/Cγ5.5 (M-A251), anti-CD45RA-APC/Cγ7 (HI100), anti-CD56-BV605 (NCAM16.2), and anti-Ki67-PE/Cγ7 (Ki-67) and analyzed by FACS as generally described in Example 2A. Percentage of Ki67 on CD8+ T cells, CD4+ T cells, γδ T cells, and NK cells are depicted in FIG. 59A-FIG. 59E.

In a sixth experiment, variant IL-15/Rα-Fc fusion proteins were incubated with human PBMCs for 3 days at 37° C. Following incubation, cells were stained with anti-CD3-PE (OKT3), anti-CD4-FITC (RPA-T4), anti-CD8α-BV510 (SKI), anti-CD8β-APC (SIDI8BEE), anti-CD16-BV421 (3G8), anti-CD25-PerCP/Cγ5.5 (M-A251), anti-CD45RA-APC/Cγ7 (HI100), anti-CD56-BV605 (NCAM16.2), and anti-Ki67-PE/Cγ7 (Ki-67) and analyzed by FACS as generally described in Example 2A. Percentage of Ki67 on CD8+ T cells, CD4+ T cells, γδ T cells, and NK cells are depicted in FIG. 60A-FIG. 60E.

In a seventh experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cγ5.5 (M-A251), anti-CD45RA-APC/Fire750 (HI100) and anti-Ki67-PE/Cγ7 (Ki-67) and analyzed by FACS as generally described in Example 2A. Percentage Ki67 on CD8+ T cells, CD4+ T cells, γδ T cells and NK (CD16+) cells are depicted in FIGS. 61A-61D. The data show that the ncIL-15/Rα-Fc fusion protein XENP21479 is the most potent inducer of CD8+ T cell, CD4+ T cell, NK (CD16+) cell, and γδ T cell proliferation. Each of the scIL-15/Rα-Fc fusion proteins were less potent than XENP21479 in inducing proliferation, but differences were dependent on both the linker length, as well as the particular engineered substitutions.

In an eighth experiment, variant IL-15/Rα-Fc fusion proteins were incubated with human PBMCs at the indicated concentrations for 3 days at 37° C. Following incubation, PBMCs were stained with anti-CD3-PE (OKT3), anti-CD4-FITC (RPA-T4), anti-CD8-APC (RPA-T8), anti-CD16-BV605 (3G8), anti-CD25-PerCP/Cγ5.5 (M-A251), anti-CD45RA-APC/Fire750 (HI100) and anti-Ki67-PE/Cγ7 (Ki-67) and analyzed by FACS as generally described in Example 2A. Percentage Ki67 on CD8+ T cells, CD4+ T cells, γδ T cells and NK (CD16+) cells are respectively depicted in FIGS. 62A-62D. As above, the data show that the ncIL-15/Rα-Fc fusion protein XENP21479 is the most potent inducer of CD8+ T cell, CD4+ T cell, NK (CD16+) cell, and γδ T cell proliferation. Notably, introduction of Q108E substitution into the ncIL-15/Rα-Fc format (XENP24349) drastically reduces its proliferative activity in comparison to wildtype (XENP21479).

E. 2C(b): PK of IL-15/Rα-Fc Fusion Proteins Engineered for Reduced Potency

In order to investigate if IL-15/Rα-Fc fusion proteins engineered for reduced potency had improved half-life and PK, we examined these variants in a PK study in C57BL/6 mice. Two cohorts of mice (5 mice per test article per cohort) were dosed with 0.1 mg/kg of the indicated test articles via IV-TV on Day 0. Serum was collected 60 minutes after dosing and then on Days 2, 4, and 7 for Cohort 1 and Days 1, 3, and 8 for Cohort 2. Serum levels of IL-15/Rα-Fc fusion proteins were determined using anti-IL-15 and anti-IL-15Rα antibodies in a sandwich ELISA. The results are depicted in FIG. 63. FIG. 64 depicts the correlation between potency and half-life of the test articles. Variants with reduced potency demonstrated substantially longer half-life. Notably, half-life was improved up to almost 9 days (see XENP22821 and XENP22822), as compared to 0.5 days for the wild-type control XENP20818.

XVII. Example 3: PD-1-Targeted IL-15/Rα-Fc Fusions

A. 3A: Generation and Physical Characterization of PD-1-Targeted IL-15/Rα-Fc Fusions Plasmids coding for IL-15, IL-15Rα sushi domain, or the anti-PD-1 variable regions were constructed by standard gene synthesis, followed by subcloning into a pTT5 expression vector containing Fc fusion partners (e.g., constant regions as depicted in FIG. 12). Cartoon schematics of illustrative PD-1-targeted IL-15/Rα-Fc fusions are depicted in FIG. 65A-FIG. 65K.

The "scIL-15/RαxscFv" format (FIG. 65A) comprises IL-15Rα(sushi) fused to IL-15 by a variable length linker (termed "scIL-15/Rα") which is then fused to the N-terminus of a heterodimeric Fc-region, with an scFv fused to the other side of the heterodimeric Fc. Sequences for illustrative proteins of this format are depicted in FIG. 66.

The "scFvxncIL-15/Rα" format (FIG. 65B) comprises an scFv fused to the N-terminus of a heterodimeric Fc-region, with IL-15Rα(sushi) fused to the other side of the heterodimeric Fc, while IL-15 is transfected separately so that a non-covalent IL-15/Rα complex is formed. Sequences for illustrative proteins of this format are depicted in FIG. 67.

The "scFvxdsIL-15/Rα" format (FIG. 65C) is the same as the "scFvxncIL-15/Rα" format, but wherein IL-15Rα(sushi) and IL-15 are covalently linked as a result of engineered cysteines. Sequences for illustrative proteins of this format are depicted in FIG. 68.

The "scIL-15/RαxFab" format (FIG. 65D) comprises IL-15Rα(sushi) fused to IL-15 by a variable length linker (termed "scIL-15/Rα") which is then fused to the N-terminus of a heterodimeric Fc-region, with a variable heavy chain (VH) fused to the other side of the heterodimeric Fc, while a corresponding light chain is transfected separately so as to form a Fab with the VH. Sequences for illustrative proteins of this format are depicted in FIG. 69A-FIG. 69D.

The "ncIL-15/RαxFab" format (FIG. 65E) comprises a VH fused to the N-terminus of a heterodimeric Fc-region, with IL-15Rα(sushi) fused to the other side of the heterodimeric Fc, while a corresponding light chain is transfected separately so as to form a Fab with the VH, and while IL-15 is transfected separately so that a non-covalent IL-15/Rα complex is formed. Sequences for illustrative proteins of this format are depicted in FIG. 70.

The "dsIL-15/RαxFab" format (FIG. 65F) is the same as the "ncIL-15/RαxFab" format, but wherein IL-15Rα(sushi) and IL-15 are covalently linked as a result of engineered cysteines. Sequences for illustrative proteins of this format are depicted in FIG. 71.

The "mAb-scIL-15/Rα" format (FIG. 65G) comprises VH fused to the N-terminus of a first and a second heterodimeric Fc, with IL-15 is fused to IL-15Rα(sushi) which is then further fused to the C-terminus of one of the heterodimeric Fc-region, while corresponding light chains are transfected separately so as to form Fabs with the VHs. Sequences for illustrative proteins of this format are depicted in FIG. 72.

The "mAb-ncIL-15/Rα" format (FIG. 65H) comprises VH fused to the N-terminus of a first and a second heterodimeric Fc, with IL-15Rα(sushi) fused to the C-terminus of one of the heterodimeric Fc-region, while corresponding light chains are transfected separately so as to form Fabs with the VHs, and while and while IL-15 is transfected separately so that a non-covalent IL-15/Rα complex is formed. Sequences for illustrative proteins of this format are depicted in FIG. 73.

The "mAb-dsIL-15/Rα" format (FIG. 65I) is the same as the "mAb-ncIL-15/Rα" format, but wherein IL-15Rα(sushi) and IL-15 are covalently linked as a result of engineered cysteines. Sequences for illustrative proteins of this format are depicted in FIG. 74.

The "central-IL-15/Rα" format (FIG. 65J) comprises a VH recombinantly fused to the N-terminus of IL-15 which is then further fused to one side of a heterodimeric Fc and a VH recombinantly fused to the N-terminus of IL-15Rα (sushi) which is then further fused to the other side of the heterodimeric Fc, while corresponding light chains are transfected separately so as to form Fabs with the VHs. Sequences for illustrative proteins of this format are depicted in FIG. 75.

The "central-scIL-15/Rα" format (FIG. 65K) comprises a VH fused to the N-terminus of IL-15Rα(sushi) which is fused to IL-15 which is then further fused to one side of a heterodimeric Fc and a VH fused to the other side of the heterodimeric Fc, while corresponding light chains are transfected separately so as to form Fabs with the VHs. Sequences for illustrative PD-1 targeted IL-15/Rα-Fc fusion proteins of this format are depicted in FIG. 76.

PD-1-targeted IL-15/Rα-Fc fusion proteins were characterized by size-exclusion chromatography (SEC) and capillary isoelectric focusing (CEF) for purity and homogeneity.

The proteins were analyzed using SEC to measure their size (i.e., hydrodynamic volume) and determine the native-like behavior of the purified samples. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1xPBS, pH 7.4 as the mobile phase at 4° C. for 25 minutes with UV detection wavelength at 280 nM. Analysis was performed using Agilent OpenLab Chromatography Data System (CDS) ChemStation Edition AIC version C.01.07. Chromatogram for an illustrative PD-1 targeted IL-15/Rα-Fc fusion protein XENP21480 in the IL-15/RαxscFv format is shown in FIG. 77B.

The proteins were analyzed electrophoretically via CEF using LabChip GXII Touch HT (PerkinElmer, Waltham, Mass.) using Protein Express Assay LabChip and Protein Express Assay Reagent Kit carried out using the manufacturer's instructions. Samples were run in duplicate, one under reducing (with dithiothreitol) and the other under non-reducing conditions. Gel image for XENP21480 is shown in FIG. 77C.

Affinity screens of the heterodimeric Fc-fusion proteins for IL-2Rß and PD-1 were performed using Octet as generally described in Example 1B(a). In a first screen, anti-human Fc (AHC) biosensors were used to capture the test articles and then dipped into multiple concentration of IL-2Rß (R&D Systems, Minneapolis, Minn.) or histidine-tagged PD-1 for $K_D$ determination. The affinity result and corresponding sensorgrams for XENP21480 are depicted in FIG. 77D-FIG. 77E. In a second screen, a HIS1K biosensors were used to capture either histidine-tagged IL-2Rß:common gamma chain complex-Fc fusion or histidine-tagged PD-1-Fc fusion and then dipped into 2 different batches of XENP25850, sensorgrams for which are depicted in FIG. 78A-FIG. 78B.

Stability of the heterodimeric Fc-fusion proteins were evaluated using Differential Scanning Fluorimetry (DSF). DSF experiments were performed using a Bio-Rad CFX Connect Real-Time PCR Detection System. Proteins were mixed with SYPRO Orange fluorescent dye and diluted to 0.2 mg/mL in PBS. The final concentration of SYPRO Orange was 10×. After an initial 10 minute incubation period at 25° C., proteins were heated from 25 to 95° C. using a heating rate of 1° C./min. A fluorescence measurement was taken every 30 sec. Melting temperatures (Tm) were calculated using the instrument software. The stability result and corresponding melting curve for XENP21480 are depicted in FIG. 77F.

B. 3B: Activity of PD-1-Targeted IL-15/Rα-Fc Fusions in Cell Proliferation Assays An illustrative PD-1-targeted IL-15/Rα-Fc fusion protein XENP21480 and controls were tested in a cell proliferation assay. Human PBMCs were treated with the test articles at the indicated concentrations. 4 days after treatment, the PBMCs were stained with anti-CD8-FITC (RPA-T8), anti-CD4-PerCP/Cγ5.5 (OKT4), anti-CD27-PE (M-T271), anti-CD56-BV421 (5.1H11), anti-CD16-BV421 (3G8), and anti-CD45RA-BV605 (Hi100) to gate for the following cell types: CD4+ T cells, CD8+ T cells, and NK cells (CD56+/CD16+). Ki67 is a protein strictly associated with cells proliferation, and staining for intracellular Ki67 was performed using anti-Ki67-APC (Ki-67) and Foxp3/Transcription Factor Staining Buffer Set (Thermo Fisher Scientific, Waltham, Mass.). The percentage of Ki67 on the above cell types was measured using FACS (depicted in FIG. 79A-FIG. 79C).

C. 3C: Activity of PD-1-Targeted IL-15/Rα-Fc Fusion Proteins in an SEB-Stimulated PBMC Assay Human PBMCs from multiple donors were stimulated with 10 ng/mL of SEB for 72 hours in combination with 20 μg/mL of an PD-1-targeted IL-15/Rα-Fc fusion or controls. After treatment, supernatant was collected and assayed for IL-2, data for which is depicted in FIG. 80.

D. 3D: PD-1-targeted IL-15/Rα-Fc fusions enhance engraftment and disease activity in human PBMC-engrafted NSG mice An illustrative PD-1-targeted IL-15/Rα-Fc fusion protein was evaluated in a Graft-versus-Host Disease (GVHD) model conducted in NSG (NOD-SCID-gamma) immunodeficient mice. When the NSG mice are injected with human PBMCs, the human PBMCs develop an autoimmune response against mouse cells. Treatment of NSG mice injected with human PBMCs followed with PD-1-targeted IL-15/Rα-Fc fusions proliferate the engrafted T cells and enhances engraftment.

In a first study, 10 million human PBMCs were engrafted into NSG mice via IV-OSP on Day −8 followed by dosing with the indicated test articles at the indicated concentrations on Day 0. IFNγ levels and human CD45+ lymphocytes, CD8+ T cell and CD4+ T cell counts were measured at Days 4, 7, and 11. FIG. 81 depicts IFNγ levels in mice serum on Days 4, 7, and 11. FIG. 82A-FIG. 82C respectively depict CD8+ T cell counts on Days 4, 7, and 11. FIG. 83A-FIG. 83C respectively depict CD4+ T cell counts on Days 4, 7, and 11. FIG. 84A-FIG. 84C respectively depict CD45+ cell counts on Days 4, 7, and 11. Body weight of the mice were also measured on Days 4, 7, and 11 and depicted as percentage of initial body weight in FIG. 85A-FIG. 85C.

In a second study, 10 million human PBMCs were engrafted into NSG mice via IV-OSP on Day −7 followed by dosing with the following test articles at the indicated concentrations on Days 0 and 19: XENP16432 (a bivalent anti-PD-1 mAb with ablated effector function based on nivolumab; sequences depicted in FIG. 86; 3.0 mg/kg), XENP24050 (0.61 mg/kg), XENP25951 (a monovalent anti-PD-1 Fab-Fc based on the PD-1 targeting arm from XENP25850; sequence depicted in FIG. 87; 0.82 mg/kg), XENP24050 in combination with XENP25951 (0.61 and 0.82 mg/kg respectively), and XENP25850 (1.0 mg/kg). Cell counts were measured at Day 4, 7, and 11, and are depicted in FIG. 88-FIG. 91 respectively for CD45+ cells, CD3+ cells, CD4+ cells, and CD8+ cells. The data show that the PD-1-targeted IL-15/Rα-Fc fusion increased CD45+, CD3+, CD4+, and CD8+ cell counts by Day 7 indicating enhanced GVHD. Notably, XENP25850 enhanced GVHD to a much greater extent than XENP24050 in combination with XENP25951, indicating that the enhanced GVHD is attributable to PD-1 targeting of the IL-15/Rα-Fc fusion rather than merely a combined effect of IL-15 and PD-1 blockade.

E. 3E: PD-1-Targeted IL-15/Rα-Fc Fusion Proteins of the Invention Preferentially Expand Activated Lymphocytes Following binding of cytokines to their receptors, Janus kinases (JAKs) associated with the receptors phosphorylate STAT proteins which then translocate into the nucleus to regulate further downstream processes. Therefore, phosphorylation of STAT proteins (in particular, STAT5, which include STAT5a and STAT5b) is one of the earliest signaling events triggered by IL-15 binding to its receptors. Accordingly, the ability of the PD-1-targeted IL-15/Rα-Fc fusions to induce STAT5 phosphorylation in various cell types was investigated.

For this experiment, both fresh and activated PBMCs were used. Activated PBMCs, used as surrogates for activated lymphocytes in the tumor environment, were prepared by stimulating fresh PBMCs with 100 ng/mL plate-bound anti-CD3 (OKT3) for 2 days. Fresh and activated PBMCs were incubated with the following test articles at the indicated concentrations for 15 minutes at 37° C.: XENP20818 (WT IL-15/Rα-Fc), XENP24050 (an illustrative reduced potency IL-15/Rα-Fc), and XENP25850 (an illustrative PD-1-targeted IL-15/Rα-Fc fusion). To gate for various cell populations following incubation, PBMCs were stained with anti-CD3-BUV395 (UCHT1), anti-CD4-BV605 (RPA-T4), and anti-CD8-Alexa700 (SKI) for 30-45 minutes at room temperature. Cells were washed and incubated with pre-chilled (−20° C.) 90% methanol for 20-60 minutes. After methanol incubation, cells were washed again and stained with anti-CD25-BV421 (M-A251), anti-CD45RA-BV510 (HI100), and anti-pSTAT5-Alexa647 (pY687) to mark various cell populations and STAT5 phosphorylation. Data depicting induction of STAT5 phosphorylation on various CD8+ and CD4+ T cell populations are depicted in FIG. 92A-FIG. 92H. Notably, the data show that the PD-1-targeted IL-15/Rα-Fc fusion protein (XENP25850) demonstrated increased effect on T cells from activated PBMCs (due to increased PD-1 expression) while maintaining minimal and in some cases reduced effect on T cells from fresh PBMCs in comparison to the equivalent non-targeted reduced potency IL-15/Rα-Fc fusion (XENP24050). This suggests that, in a clinical setting, the PD-1-targeted IL-15/Rα-Fc fusions will be selective for activated tumor-infiltrating lymphocytes in the tumor environment that have higher PD-1 expression.

XVIII. Example 4: PD-1-Targeted IL-15/Rα-Fc Fusions with Tuned PD-1 Affinity

A. 4A: Affinity-Engineering PD-1-Targeting Arm

Next, we sought to optimize the affinity of the PD-1-targeting arm. We generated libraries of variants based on the variable regions of anti-PD-1 clone 1C11 humanized variant H3L3 (as in XENP22553) in the context of scFvs (sequences for which are depicted in FIG. 93A-FIG. 93S), in the context of bivalent mAbs (sequences for which are depicted in FIG. 94A-FIG. 94AO), and in the context of variable heavy and variable light chains (sequences for which are depicted respectively in FIG. 95A-FIG. 95J and FIG. 96A-FIG. 96F).

To determine the affinity of the variants from the scFv library, the variable regions from the scFvs were formatted as Fabs in a bivalent IgG1 with E233P/L234V/L235A/G236del/S267K substitutions. DNA encoding the heavy and light chains were generated by gene synthesis and subcloned using standard molecular biology techniques into pTT5 expression vector containing IgG1 constant regions, and transiently transfected into HEK293E cells. Affinity screens of supernatant were performed using Octet. Anti-human Fc (AHC) biosensors were used to capture 1:2 dilutions of each supernatant to a density of 2.0 nm, and dipped into PD-1-His for $K_D$ determination. Affinity results are depicted in FIG. 97A-FIG. 97Q.

Affinity screen of variants from the bivalent mAb library were also performed in a number of experiments using Octet as described above, results for which are depicted in FIG. 98-FIG. 104.

Affinity screen of variants based on combinations of variable heavy and variable light chain variants formatted in bivalent IgG1 format were also performed in a couple of experiments using Octet as described above, results for which are depicted in FIG. 105A-FIG. 105E and FIG. 106.

Affinity screen of selected 1C11 variants (as well as control mAbs based on nivolumab (XENP16432) and pembrolizumab (XENP21461)) were also determined using Biacore, a surface plasmon resonance (SPR)-based technology. Experimental steps for Biacore generally included the following: Immobilization (capture of ligand onto a sensor chip); Association (flowing of various concentrations of analyte over sensor chip); and Dissociation (flowing buffer over the sensor chips) in order to determine the affinity of the test articles. A reference flow with buffer alone was also included in the method for background correction during data processing. Binding affinities and kinetic rate constants were obtained by analyzing the processed data using a 1:1 binding model. In particular, anti-PD-1 mAbs were captured onto Protein A sensor chips, and then multiple concentrations of histidine-tagged human PD-1 or histidine tagged cyno PD-1 were flowed over the sensor chips. The resulting dissociation constants (1(D) are depicted in FIG. 107.

Finally, we investigated T cell surface binding of affinity optimized 1C11 variants. Binding of affinity optimized 1C11 variants to T cells was measured in an SEB-stimulated PBMC assay. Human PBMCs were stimulated with 500 ng/mL SEB for 3 days. Following stimulation, PBMCs were incubated with the indicated test articles at indicated concentrations 30 min. PBMCs were stained with anti-CD3-FITC (UCHT1) and A647 labeled antibody for human Fc. The binding of the test articles to T cells as indicated by A647 MFI on FITC+ cells is depicted in FIG. 108.

B. 4B: Activity of PD-1-Targeted IL-15/Rα-Fc Fusions Correlate with PD-1 Affinity We engineered and produced illustrative PD-1-targeted IL-15/Rα-Fc fusions comprising affinity-engineered PD-1-targeting arms as generally described in Example 3A, sequences for which are depicted in FIG. 109A-FIG. 109D, and investigated their activity.

Human PBMCs were stimulated for 48 hours with 500 ng/ml plate-bound anti-CD3 (OKT3) and then labeled with CFSE and incubated with the following test articles for 4 days at 37° C.: XENP25850 (PD-1-targeted IL-15/Rα-Fc fusion based on 1C11_H3L3); XENP29159 (PD-1-targeted IL-15/Rα-Fc fusion based on affinity-matured 1C11_H3.329_L3.220); XENP24306 (control untargeted IL-15(D30N/E64Q/N65D)/Rα-Fc fusion having D30N/E64Q/N65D IL-15 variant); and XENP26007 (control RSV-targeted IL-15/Rα-Fc fusion having N4D/N65D IL-15 variant). Cells were stained with the following antibodies: anti-LAG-3-PE (3DS223H), anti-CD8-PerCP-Cγ5.5 (SKI), anti-CD3-PE-Cγ7 (OKT3), anti-CD45RO-APC-Fire750 (UCHL1), anti-HLA-DR-Alexa700 (L243), anti-CD16-BV605 (3G6), anti-CD56-BV605 (HCD56), anti-CD25-BV711 (M-A251), anti-CD45RA-BV785 (HI100), anti-CD4-BUV395 (SK3), and Zombie Aqua-BV510 and analyzed by flow for various cell populations.

We investigated the proliferation of various T cell and NK cell populations based on CFSE dilution (Zombie Aqua to exclude dead cells), data for which are depicted in FIG. 110A-FIG. 110B, FIG. 111A-FIG. 111B, FIG. 112A-FIG. 112B, FIG. 113A-FIG. 113B, FIG. 114A-FIG. 114B, FIG. 115A-FIG. 115B. The data show that PD-1-targeted IL-15/Rα-Fc fusions are much more potent in inducing proliferation of CD4+ T cells in comparison to untargeted IL-15 (D30N/E64Q/N65D)/Rα-Fc fusion (as well as control RSV-targeted IL-15/Rα-Fc fusion). Notably, the PD-1-targeted IL-15/Rα-Fc fusions preferentially targets memory T cells, suggesting that in a clinical setting, the PD-1-targeted IL-15/Rα-Fc fusions will be selective for activated tumor-infiltrating lymphocytes in the tumor environment.

We also investigated the activation of various T cell populations based on expression of CD25 (a late stage T cell activation marker) and HLA-DR (another activation marker), data for which are depicted in FIG. 116A-FIG. 116D, FIG. 117A-FIG. 117D, and FIG. 118A-FIG. 118D. The data show that PD-1-targeted IL-15/Rα-Fc fusions generally appear more potent in inducing activation of the various T cell populations in comparison to untargeted IL-15(D30N/E64Q/N65D)/Rα-Fc fusion (as well as control RSV-targeted IL-15/Rα-Fc fusion).

Collectively, the data show that activity of the PD-1-targeted IL-15/Rα-Fc fusions correlate with PD-1 affinity. For example, as shown in FIG. 110A-FIG. 110D, XENP29159 (having an affinity-enhanced PD-1-targeting arm) induces proliferation of both CD8+ and CD4+ T cells more potently than does XENP25850.

XIX. Example 5: PD-1-Targeted IL-15/Rα-Fc Fusions with Tuned IL-15 Potency

A. 5A: IL-15(D30N/N65D) Variant

In a study investigating the pharmacokinetics of IL-15-Fc potency variants with Xtend, cynomolgus monkeys were administered a first single intravenous (i.v.) dose of XENP22853 (WT IL-15/Rα-heteroFc with Xtend; sequences depicted in FIG. 119), XENP24306 (IL-15 (D30N/E64Q/N65D)/Rα-heteroFc with Xtend; sequences depicted in FIG. 122), XENP24113 (IL-15(N4D/N65D)/Rα-heteroFc with Xtend; sequences depicted in FIG. 120), and XENP24294 (scIL-15(N4D/N65D)/Rα-Fc with Xtend; sequences depicted in FIG. 121) at varying concentrations.

FIG. 123 depicts the serum concentration of the test articles over time following the first dose. As expected, incorporating potency variants in addition to Xtend substitution (as in XENP24306 and XENP24113) greatly improves the pharmacokinetics of IL-15-Fc fusions (in comparison to XENP22583). Unexpectedly, however, IL-15/Rα-heteroFc fusion XENP24113 and scIL-15/Rα-Fc fusion XENP24294 (which have the same IL-15(N4D/N65D) potency variant) demonstrated reduced pharmacokinetics in comparison to XENP24306. This suggests that the reduced pharmacokinetics was due to the particular IL-15 potency variant rather than the format of the IL-15-Fc fusion. While a decrease in pharmacokinetics for XENP24113 and XENP24294 was expected on the basis of previous findings which demonstrated that the IL-15-Fc fusions having IL-15(N4D/N65D) variant had greater in vitro potency than IL-15-Fc fusions having the IL-15(D30N/E64Q/N65D) variant, the decrease in pharmacokinetics was unexpectedly disproportionate to the increase in potency. Accordingly, we sought to identify alternative IL-15 potency variants for use in the LAG-3-targeted IL-15-Fc fusions of the invention.

We noted that IL-15(N4D/N65D) has both its substitutions at the IL-15 interface responsible for binding to CD122, while IL-15(D30N/E64Q/N65D) has two substitutions (E64Q and N65D) at IL-15:CD122 interface; and one substitution (D30N) at the IL-15 interface responsible for binding to CD132. Accordingly, we reasoned that the modification at the IL-15:CD132 interface may contribute to the superior pharmacokinetics observed for XENP24306. Notably, we found that scIL-15/Rα-Fc fusions comprising IL-15 (N4D/N65D) variant and IL-15(D30N/N65D) variant demonstrated very similar potency in vitro, as depicted in FIG. 125. In view of the above, we conceived illustrative PD-1-targeted IL-15-Fc fusion comprising the IL-15(D30N/N65D) variants, sequences for which are depicted in FIG. 126A-FIG. 126D. We also generated a control RSV-targeted IL-15/Rα-Fc fusion protein XENP29481 with IL-15(D30N/N65D) variant, sequences for which are depicted in FIG. 129A-FIG. 129B.

B. 5B: IL-15(D30N/E64Q/N65D) Variant

Although the PD-1-targeted IL-15/Rα-Fc fusions were designed with the aim to be targeted to the tumor environment via the PD-1-targeting arm, the cytokine moiety is still capable of signaling before reaching the tumor site and may contribute to systemic toxicity. Accordingly, we sought to further reduce the IL-15 potency by constructing PD-1-targeted IL-15/Rα-Fc fusions with IL-15(D30N/E64Q/N65D) variant, which as illustrated in Example 2C has drastically reduced activity and in FIG. 125. Sequences for illustrative PD-1-targeted IL-15/Rα-Fc fusions comprising IL-15(D30N/E64Q/N65D) variant are depicted in FIG. 127A-FIG. 127D. Additionally, we constructed XENP30432, a RSV-targeted IL-15/Rα-Fc fusion comprising IL-15(D30N/E64Q/N65D) variant (sequences for which are depicted in FIG. 129A-FIG. 129B), to act as a surrogate for investigating the behavior of PD-1-targeted IL-15/Rα-Fc fusions comprising IL-15(D30N/E64Q/N65D) variant outside of the tumor environment.

SEQUENCE LISTING (1221 sequences)

SEQ ID NO: 1 - protein, 162 aa, Homo sapiens
MRISKPHLRSISIQCYLCLLLNSHFLTEAGIHVFILGCFSAGLPKTEANWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 2 - protein, 114 aa, Homo sapiens
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 3 - protein, 267 aa, Homo sapiens
MAPRRARGCRTLGLPALLLLLLLRPPATRGITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTTVAISTSTVLLCGLSAVSLLACYLKSRQTPPLASVEMEAMEALPVTWGTSSRDEDLENCSHHL

SEQ ID NO: 4 - protein, 65 aa, Homo sapiens
ITCPPPMSVEHADIWVKSYSLYSRERYICNSGFKRKAGTSSLTECVLNKATNVAHWTTPSLKCIR

SEQ ID NO: 5 - protein, 162 aa, Homo sapiens; identical to SEQ ID NO: 1

SEQ ID NO: 6 - protein, 114 aa, Homo sapiens; identical to SEQ ID NO: 2

SEQ ID NO: 7 - protein, 267 aa, Homo sapiens; identical to SEQ ID NO: 3

SEQ ID NO: 8 - protein, 175 aa, Homo sapiens
ITCPPPMSVEHADIWVKSYSLYSRERYICNSGFKRKAGTSSLTECVLNKATNVAHWTTPSLKCIRDPALVHQRPAPPSTVTTAGVTPQPESLSPSGKEPAASSPSSNNTAATTAAIVPGSQLMPSKSPSTGTTEISSHESSHGTPSQTTAKNWELTASASHQPPGVYPQGHSDTT

SEQ ID NO: 9 - protein, 65 aa, Homo sapiens; identical to SEQ ID NO: 4

SEQ ID NO: 10 - protein, 551 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAFGFIILVYLLINCRNTGPWLKKVLKCNTPDPSKFFSQLSSEHGGDVQKWLSSPFPSSSFSPGGLAPEISPLEVLERDKVTQLLLQQDKVPEPASLSSNHSLTSCFTNQGYFFFHLPDALEIEACQVYFTYDPYSEEDPDEGVAGAPTGSSPQPLQPLSGEDDAYCTFPSRDDLLLFSPSLLGGPSPPSTAPGGSGAGEERMPPSLQERVPRDWDPQPLGPPTPGVPDLVDFQPPPELVLREAGEEVPDAGPREGVSFPWSRPPGQGEFRALNARLPLNTDAYLSLQELQGQDPTHLV

SEQ ID NO: 11 - protein, 214 aa, Homo sapiens
AVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDT

SEQ ID NO: 12 - protein, 369 aa, Homo sapiens
MLKPSLPFTSLLFLQLPLLGVGLNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEAVVISVGSMGLIISLLCVYFWLERTMPRIPTLKNLEDLVTEYHGNFSAWSGVSKGLAESLQPDYSERLCLVSEIPPKGGALGEGPGASPCNQHSPYWAPPCYTLKPET

SEQ ID NO: 13 - protein, 240 aa, Artificial Sequence
  Description of Artificial Sequence: Synthetic polypeptide
LNTTILTPNGNEDTTADFFLTTMPTDSLSVSTLPLPEVQCFVFNVEYMNCTWNSSSEPQPTNLTLHYWYKNSDNDKVQKCSHYLFSEEITSGCQLQKKEIHLYQTFVVQLQDPREPRRQATQMLKLQNLVIPWAPENLTLHKLSESQLELNWNNRFLNHCLEHLVQYRTDWDHSWTEQSVDYRHKFSLPSVDGQKRYTFRVRSRFNPLCGSAQHWSEWSHPIHWGSNTSKENPFLFALEA

SEQ ID NO: 14 - protein, 5 aa, Artificial Sequence
  Description of Artificial Sequence: Synthetic peptide
GGGGS

SEQ ID NO: 15 - protein, 10 aa, Artificial Sequence
  Description of Artificial Sequence: Synthetic peptide
GGGGSGGGGS

SEQ ID NO: 16 - protein, 15 aa, Artificial Sequence
  Description of Artificial Sequence: Synthetic peptide
GGGGSGGGGSGGGGS

SEQ ID NO: 17 - protein, 20 aa, Artificial Sequence
  Description of Artificial Sequence: Synthetic peptide
GGGGSGGGGSGGGGSGGGGS

SEQ ID NO: 18 - protein, 25 aa, Artificial Sequence
  Description of Artificial Sequence: Synthetic peptide
GGGGSGGGGSGGGGSGGGGSGGGGS

SEQ ID NO: 19 - protein, 30 aa, Artificial Sequence
  Description of Artificial Sequence: Synthetic polypeptide
GGGGSGGGGSGGGGSGGGGSGGGGSGGGGS

SEQ ID NO: 20 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 21 - protein, 30 aa, Artificial Sequence
  Description of Artificial Sequence: Synthetic polypeptide
DPALVHQRPAPPGGGGSGGGGSGGGGSGGG

SEQ ID NO: 22 - protein, 5 aa, Artificial Sequence
  Description of Artificial Sequence: Synthetic peptide
GKPGS

SEQ ID NO: 23 - protein, 25 aa, Artificial Sequence
  Description of Artificial Sequence: Synthetic peptide
GKPGSGKPGSGKPGSGKPGSGKPGS

SEQ ID NO: 24 - protein, 30 aa, Artificial Sequence
  Description of Artificial Sequence: Synthetic polypeptide
GKPGSGKPGSGKPGSGKPGSGKPGSGKPGS

SEQ ID NO: 25 - protein, 5 aa, Artificial Sequence
  Description of Artificial Sequence: Synthetic peptide
GGGES

SEQ ID NO: 26 - protein, 15 aa, Artificial Sequence
  Description of Artificial Sequence: Synthetic peptide
GGGGSGGGGSGGGGS

SEQ ID NO: 27 - protein, 18 aa, Artificial Sequence
  Description of Artificial Sequence: Synthetic peptide
GSTSGSGKPGSGEGSTKG

SEQ ID NO: 28 - protein, 14 aa, Artificial Sequence
  Description of Artificial Sequence: Synthetic peptide
IRPRAIGGSKPRVA

SEQ ID NO: 29 - protein, 15 aa, Artificial Sequence
  Description of Artificial Sequence: Synthetic peptide
GKGGSGKGGSGKGGS

SEQ ID NO: 30 - protein, 15 aa, Artificial Sequence
  Description of Artificial Sequence: Synthetic peptide
GGKGSGGKGSGGKGS

SEQ ID NO: 31 - protein, 15 aa, Artificial Sequence
  Description of Artificial Sequence: Synthetic peptide
GGGKSGGGKSGGGKS

SEQ ID NO: 32 - protein, 15 aa, Artificial Sequence
  Description of Artificial Sequence: Synthetic peptide
GKGKSGKGKSGKGKS

SEQ ID NO: 33 - protein, 15 aa, Artificial Sequence
  Description of Artificial Sequence: Synthetic peptide
GGGKSGGKGSGKGGS

SEQ ID NO: 34 - protein, 15 aa, Artificial Sequence
  Description of Artificial Sequence: Synthetic peptide
GKPGSGKPGSGKPGS

SEQ ID NO: 35 - protein, 20 aa, Artificial Sequence
  Description of Artificial Sequence: Synthetic peptide
GKPGSGKPGSGKPGSGKPGS

SEQ ID NO: 36 - protein, 20 aa, Artificial Sequence
  Description of Artificial Sequence: Synthetic peptide
GKGKSGKGKSGKGKSGKGKS

SEQ ID NO: 37 - protein, 20 aa, Artificial Sequence
  Description of Artificial Sequence: Synthetic peptide
GGGGSGGGGSGGGGSGGGGS

SEQ ID NO: 38 - protein, 14 aa, Artificial Sequence
  Description of Artificial Sequence: Synthetic peptide
STAGDTHLGGEDFD

SEQ ID NO: 39 - protein, 15 aa, Artificial Sequence
  Description of Artificial Sequence: Synthetic peptide
GEGGSGEGGSGEGGS

SEQ ID NO: 40 - protein, 15 aa, Artificial Sequence
  Description of Artificial Sequence: Synthetic peptide
GGEGSGGEGSGGEGS

SEQ ID NO: 41 - protein, 15 aa, Artificial Sequence
  Description of Artificial Sequence: Synthetic peptide
GGGESGGGESGGGES

SEQ ID NO: 42 - protein, 15 aa, Artificial Sequence
  Description of Artificial Sequence: Synthetic peptide
GEGESGEGESGEGES

SEQ ID NO: 43 - protein, 15 aa, Artificial Sequence
  Description of Artificial Sequence: Synthetic peptide
GGGESGGEGSGEGGS

SEQ ID NO: 44 - protein, 20 aa, Artificial Sequence
  Description of Artificial Sequence: Synthetic peptide
GEGESGEGESGEGESGEGES

SEQ ID NO: 45 - protein, 15 aa, Artificial Sequence
  Description of Artificial Sequence: Synthetic peptide
GGGGSGGGGSGGGGS

SEQ ID NO: 46 - protein, 20 aa, Artificial Sequence
  Description of Artificial Sequence: Synthetic peptide
GGGGSGGGGSGGGGSGGGGS

SEQ ID NO: 47 - protein, 18 aa, Artificial Sequence
  Description of Artificial Sequence: Synthetic peptide
GSTSGSGKPGSGEGSTKG

SEQ ID NO: 48 - protein, 19 aa, Artificial Sequence
  Description of Artificial Sequence: Synthetic peptide
PRGASKSGSASQTGSAPGS

SEQ ID NO: 49 - protein, 19 aa, Artificial Sequence
  Description of Artificial Sequence: Synthetic peptide
GTAAAGAGAAGGAAAGAAG

SEQ ID NO: 50 - protein, 19 aa, Artificial Sequence
  Description of Artificial Sequence: Synthetic peptide
GTSGSSGSGSGGSGSGGGG

SEQ ID NO: 51 - protein, 20 aa, Artificial Sequence
  Description of Artificial Sequence: Synthetic peptide
GKPGSGKPGSGKPGSGKPGS

SEQ ID NO: 52 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 53 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 54 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 55 - protein, 231 aa, Artificial Sequence; identical to SEQ ID NO: 53
  Description of Artificial Sequence: Synthetic polypeptide

SEQ ID NO: 56 - protein, 231 aa, Artificial Sequence; identical to SEQ ID NO: 54
  Description of Artificial Sequence: Synthetic polypeptide

SEQ ID NO: 57 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 58 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 59 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 60 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 62 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 64 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 66 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 67 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 68 - protein, 228 aa, Artificial Sequence
  Description of Artificial Sequence: Synthetic polypeptide
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 69 - protein, 228 aa, Artificial Sequence
  Description of Artificial Sequence: Synthetic polypeptide
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 70 - protein, 228 aa, Artificial Sequence
  Description of Artificial Sequence: Synthetic polypeptide
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 71 - protein, 228 aa, Artificial Sequence
  Description of Artificial Sequence: Synthetic polypeptide
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 72 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 73 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 74 - protein, 231 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 231 aa, Artificial Sequence; identical to SEQ ID NO: 74
  Description of Artificial Sequence: Synthetic polypeptide

SEQ ID NO: 76 - protein, 231 aa, Artificial Sequence; identical to SEQ ID NO: 53
  Description of Artificial Sequence: Synthetic polypeptide

SEQ ID NO: 77 - protein, 231 aa, Artificial Sequence
  Description of Artificial Sequence: Synthetic polypeptide
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 231 aa, Artificial Sequence; identical to SEQ ID NO: 53
  Description of Artificial Sequence: Synthetic polypeptide

SEQ ID NO: 80 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 81 - protein, 231 aa, Artificial Sequence; identical to SEQ ID NO: 52
  Description of Artificial Sequence: Synthetic polypeptide

SEQ ID NO: 82 - protein, 329 aa, Artificial Sequence; identical to SEQ ID NO: 80
  Description of Artificial Sequence: Synthetic polypeptide

SEQ ID NO: 83 - protein, 329 aa, Artificial Sequence
  Description of Artificial Sequence: Synthetic polypeptide
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 107 aa, Artificial Sequence [sequence omitted]

SEQ ID NO: 85 - protein, 106 aa, Artificial Sequence
  Description of Artificial Sequence: Synthetic polypeptide
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 86 - protein, 122 aa, Artificial Sequence
  Description of Artificial Sequence: Synthetic polypeptide
EVQLVESGGGLVKPGGSLRLSCAASGFTFSNYWMNWVRQAPGKGLEWVGEIRLKSNNYATHYAEPVKGRFTISRDDSKSTVYLQMNSLKTEDTAVYYCTRYYGNYGGYFDVWGAGTLVTVSS

SEQ ID NO: 87 - protein, 107 aa, Artificial Sequence
  Description of Artificial Sequence: Synthetic polypeptide
SIVMTQSPATLSVSPGERATLSCRASQSVSNDVAWYQQKPGQSPRLLINYASHRYTGVPDRFTGSGYGTEFTLTISSLQSEDFAVYFCQQDYSSPRTFGGGTKVEIK

SEQ ID NO: 88 - protein, 122 aa, Artificial Sequence
  Description of Artificial Sequence: Synthetic polypeptide
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSS

SEQ ID NO: 89 - protein, 107 aa, Artificial Sequence
  Description of Artificial Sequence: Synthetic polypeptide
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIK

SEQ ID NO: 90 - protein, 120 aa, Artificial Sequence [sequence omitted]

SEQ ID NO: 91 - protein, 111 aa, Artificial Sequence [sequence omitted]

SEQ ID NO: 92 - protein, 113 aa, Artificial Sequence [sequence omitted]

SEQ ID NO: 93 - protein, 107 aa, Artificial Sequence [sequence omitted]

SEQ ID NO: 94 - protein, 117 aa, Artificial Sequence
  Description of Artificial Sequence: Synthetic polypeptide
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 95 - protein, 106 aa, Artificial Sequence
  Description of Artificial Sequence: Synthetic polypeptide
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 96 - protein, 120 aa, Artificial Sequence [sequence omitted]

SEQ ID NO: 97 - protein, 111 aa, Artificial Sequence [sequence omitted]

SEQ ID NO: 98 - protein, 117 aa, Artificial Sequence
  Description of Artificial Sequence: Synthetic polypeptide
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 99 - protein, 113 aa, Artificial Sequence
  Description of Artificial Sequence: Synthetic polypeptide
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 100 - protein, 117 aa, Artificial Sequence; identical to SEQ ID NO: 98
  Description of Artificial Sequence: Synthetic polypeptide

SEQ ID NO: 101 - protein, 113 aa, Artificial Sequence
  Description of Artificial Sequence: Synthetic polypeptide
EIVLTQSPATLSLSPGERATLSCKSSQSLLDSGNQKNFLTWYQQKPGKAPKLLIYWASTRESGVPSRFSGSGSGTDFTFTISSLQPEDIATYYCQNDYSYPYTFGQGTKVEIK

SEQ ID NO: 102 - protein, 117 aa, Artificial Sequence [sequence omitted]

SEQ ID NO: 103 - protein, 107 aa, Artificial Sequence [sequence omitted]

SEQ ID NO: 104 - protein, 122 aa, Artificial Sequence
  Description of Artificial Sequence: Synthetic polypeptide
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 105 - protein, 106 aa, Artificial Sequence
  Description of Artificial Sequence: Synthetic polypeptide
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 106 - protein, 117 aa, Artificial Sequence
  Description of Artificial Sequence: Synthetic polypeptide
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSSA

SEQ ID NO: 107 - protein, 108 aa, Artificial Sequence
  Description of Artificial Sequence: Synthetic polypeptide
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIKR

SEQ ID NO: 108 - protein, 116 aa, Artificial Sequence
  Description of Artificial Sequence: Synthetic polypeptide
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 109 - protein, 107 aa, Artificial Sequence
  Description of Artificial Sequence: Synthetic polypeptide
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 110 - protein, 118 aa, Artificial Sequence
  Description of Artificial Sequence: Synthetic polypeptide
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 111 - protein, 107 aa, Artificial Sequence
  Description of Artificial Sequence: Synthetic polypeptide
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 112 - protein, 114 aa, Artificial Sequence
  Description of Artificial Sequence: Synthetic polypeptide
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 113 - protein, 110 aa, Artificial Sequence
  Description of Artificial Sequence: Synthetic polypeptide
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 114 - protein, 119 aa, Artificial Sequence
  Description of Artificial Sequence: Synthetic polypeptide
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 115 - protein, 111 aa, Artificial Sequence
  Description of Artificial Sequence: Synthetic polypeptide
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 116 - protein, 125 aa, Artificial Sequence [sequence omitted]

SEQ ID NO: 117 - protein, 112 aa, Artificial Sequence [sequence omitted]

SEQ ID NO: 118 - protein, 125 aa, Artificial Sequence
  Description of Artificial Sequence: Synthetic polypeptide
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 119 - protein, 112 aa, Artificial Sequence [sequence omitted]

SEQ ID NO: 120 - protein, 125 aa, Artificial Sequence
  Description of Artificial Sequence: Synthetic polypeptide
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 121 - protein, 112 aa, Artificial Sequence [sequence omitted]

SEQ ID NO: 122 - protein, 125 aa, Artificial Sequence; identical to SEQ ID NO: 118
  Description of Artificial Sequence: Synthetic polypeptide

SEQ ID NO: 123 - protein, 112 aa, Artificial Sequence
  Description of Artificial Sequence: Synthetic polypeptide
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 124 - protein, 128 aa, Artificial Sequence
  Description of Artificial Sequence: Synthetic polypeptide
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 125 - protein, 110 aa, Artificial Sequence
  Description of Artificial Sequence: Synthetic polypeptide
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 126 - protein, 119 aa, Artificial Sequence
  Description of Artificial Sequence: Synthetic polypeptide
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 127 - protein, 108 aa, Artificial Sequence
  Description of Artificial Sequence: Synthetic polypeptide
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 128 - protein, 119 aa, Artificial Sequence
  Description of Artificial Sequence: Synthetic polypeptide
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 129 - protein, 111 aa, Artificial Sequence
  Description of Artificial Sequence: Synthetic polypeptide
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 130 - protein, 127 aa, Artificial Sequence
  Description of Artificial Sequence: Synthetic polypeptide
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 131 - protein, 112 aa, Artificial Sequence
  Description of Artificial Sequence: Synthetic polypeptide
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 132 - protein, 127 aa, Artificial Sequence
  Description of Artificial Sequence: Synthetic polypeptide
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 133 - protein, 110 aa, Artificial Sequence
  Description of Artificial Sequence: Synthetic polypeptide
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 134 - protein, 119 aa, Artificial Sequence
  Description of Artificial Sequence: Synthetic polypeptide
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVS

SEQ ID NO: 135 - protein, 112 aa, Artificial Sequence
  Description of Artificial Sequence: Synthetic polypeptide
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 136 - protein, 121 aa, Artificial Sequence
  Description of Artificial Sequence: Synthetic polypeptide
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 137 - protein, 111 aa, Artificial Sequence
  Description of Artificial Sequence: Synthetic polypeptide
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 138 - protein, 119 aa, Artificial Sequence
  Description of Artificial Sequence: Synthetic polypeptide
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 139 - protein, 111 aa, Artificial Sequence
  Description of Artificial Sequence: Synthetic polypeptide
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 140 - protein, 119 aa, Artificial Sequence
  Description of Artificial Sequence: Synthetic polypeptide
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 141 - protein, 111 aa, Artificial Sequence; identical to SEQ ID NO: 139
  Description of Artificial Sequence: Synthetic polypeptide

SEQ ID NO: 142-144 - skipped (3 entries)

SEQ ID NO: 145 - protein, 119 aa, Artificial Sequence
  Description of Artificial Sequence: Synthetic polypeptide
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 146 - protein, 111 aa, Artificial Sequence; identical to SEQ ID NO: 139
  Description of Artificial Sequence: Synthetic polypeptide

SEQ ID NO: 147 - protein, 119 aa, Artificial Sequence
  Description of Artificial Sequence: Synthetic polypeptide
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 148 - protein, 111 aa, Artificial Sequence; identical to SEQ ID NO: 139
  Description of Artificial Sequence: Synthetic polypeptide

SEQ ID NO: 149 - protein, 118 aa, Artificial Sequence
  Description of Artificial Sequence: Synthetic polypeptide
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 150 - protein, 111 aa, Artificial Sequence; identical to SEQ ID NO: 139
  Description of Artificial Sequence: Synthetic polypeptide

SEQ ID NO: 151 - protein, 119 aa, Artificial Sequence
  Description of Artificial Sequence: Synthetic polypeptide
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 152 - protein, 111 aa, Artificial Sequence; identical to SEQ ID NO: 139
  Description of Artificial Sequence: Synthetic polypeptide

SEQ ID NO: 153 - protein, 119 aa, Artificial Sequence
  Description of Artificial Sequence: Synthetic polypeptide
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 154 - protein, 111 aa, Artificial Sequence; identical to SEQ ID NO: 139
  Description of Artificial Sequence: Synthetic polypeptide

SEQ ID NO: 155 - protein, 119 aa, Artificial Sequence
  Description of Artificial Sequence: Synthetic polypeptide
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 156 - protein, 111 aa, Artificial Sequence; identical to SEQ ID NO: 139
  Description of Artificial Sequence: Synthetic polypeptide

SEQ ID NO: 157 - protein, 119 aa, Artificial Sequence
  Description of Artificial Sequence: Synthetic polypeptide
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 158 - protein, 111 aa, Artificial Sequence; identical to SEQ ID NO: 139
  Description of Artificial Sequence: Synthetic polypeptide

SEQ ID NO: 159 - protein, 117 aa, Artificial Sequence
  Description of Artificial Sequence: Synthetic polypeptide
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 160 - protein, 113 aa, Artificial Sequence
  Description of Artificial Sequence: Synthetic polypeptide
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 161 - protein, 124 aa, Artificial Sequence
  Description of Artificial Sequence: Synthetic polypeptide
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 162 - protein, 113 aa, Artificial Sequence
  Description of Artificial Sequence: Synthetic polypeptide
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIKR

SEQ ID NO: 163 - protein, 446 aa, Artificial Sequence
  Description of Artificial Sequence: Synthetic polypeptide
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 164 - protein, 219 aa, Artificial Sequence
  Description of Artificial Sequence: Synthetic polypeptide
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 165 - skipped

SEQ ID NO: 166 - protein, 446 aa, Artificial Sequence
  Description of Artificial Sequence: Synthetic polypeptide
QIQLVQSGAEVKKPGASVKVSCKASGYTFTHYGMNWVRQAPGQGLEWMGWINTYTGEPTYADKFQGRVTMTLDTSTSTAYMELSSLRSEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 219 aa, Artificial Sequence
  Description of Artificial Sequence: Synthetic polypeptide
DVLMTQSPLSLPVTPGEPASISCRSSQSIVHSNGNTYLEWYLQKPGQSPQLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 446 aa, Artificial Sequence
  Description of Artificial Sequence: Synthetic polypeptide
EIQLLESGGGLVQPGGSLRLSCAASGYTFTHYGMNWVRQAPGKGLEWVSWINTYTGEPTYADSVKGRFTISLDTSKSTAYLQMNSLRAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 219 aa, Artificial Sequence; identical to SEQ ID NO: 167
  Description of Artificial Sequence: Synthetic polypeptide

SEQ ID NO: 170 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 219 aa, Artificial Sequence; identical to SEQ ID NO: 167
  Description of Artificial Sequence: Synthetic polypeptide

SEQ ID NO: 172 - protein, 446 aa, Artificial Sequence
  Description of Artificial Sequence: Synthetic polypeptide
EVQLLESGGGLVQPGGSLRLSCAASGYTFTHYGMNWVRQAPGKGLEWVSWINTYTGEPTYADSVKGRFTISLDTSKSTAYLQMNSLRAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 173 - protein, 219 aa, Artificial Sequence; identical to SEQ ID NO: 167
  Description of Artificial Sequence: Synthetic polypeptide

SEQ ID NO: 174 - protein, 446 aa, Artificial Sequence; identical to SEQ ID NO: 166
  Description of Artificial Sequence: Synthetic polypeptide

SEQ ID NO: 175 - protein, 219 aa, Artificial Sequence
  Description of Artificial Sequence: Synthetic polypeptide
DVLMTQSPLSLPVTLGQPASISCRSSQSIVHSNGNTYLEWYQQRPGQSPRLLIYKVSNRFSGVPDRFSGSGSGTDFTLKISRVEAEDVGVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 176 - protein, 446 aa, Artificial Sequence; identical to SEQ ID NO: 168
  Description of Artificial Sequence: Synthetic polypeptide

SEQ ID NO: 177 - protein, 219 aa, Artificial Sequence; identical to SEQ ID NO: 175
  Description of Artificial Sequence: Synthetic polypeptide

SEQ ID NO: 178 - protein, 446 aa, Artificial Sequence; identical to SEQ ID NO: 170
  Description of Artificial Sequence: Synthetic polypeptide

SEQ ID NO: 179 - protein, 219 aa, Artificial Sequence; identical to SEQ ID NO: 175
  Description of Artificial Sequence: Synthetic polypeptide

SEQ ID NO: 180 - protein, 446 aa, Artificial Sequence; identical to SEQ ID NO: 172
  Description of Artificial Sequence: Synthetic polypeptide

SEQ ID NO: 181 - protein, 219 aa, Artificial Sequence; identical to SEQ ID NO: 175
  Description of Artificial Sequence: Synthetic polypeptide

SEQ ID NO: 182 - protein, 446 aa, Artificial Sequence; identical to SEQ ID NO: 166
  Description of Artificial Sequence: Synthetic polypeptide

SEQ ID NO: 183 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 184 - protein, 446 aa, Artificial Sequence; identical to SEQ ID NO: 168
  Description of Artificial Sequence: Synthetic polypeptide

SEQ ID NO: 185 - protein, 219 aa, Artificial Sequence; identical to SEQ ID NO: 183
  Description of Artificial Sequence: Synthetic polypeptide

SEQ ID NO: 186 - protein, 446 aa, Artificial Sequence; identical to SEQ ID NO: 170
  Description of Artificial Sequence: Synthetic polypeptide

SEQ ID NO: 187 - protein, 219 aa, Artificial Sequence; identical to SEQ ID NO: 183
  Description of Artificial Sequence: Synthetic polypeptide

SEQ ID NO: 188 - protein, 446 aa, Artificial Sequence; identical to SEQ ID NO: 172
  Description of Artificial Sequence: Synthetic polypeptide

SEQ ID NO: 189 - protein, 219 aa, Artificial Sequence; identical to SEQ ID NO: 183
  Description of Artificial Sequence: Synthetic polypeptide

SEQ ID NO: 190 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 191 - protein, 301 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 192 - protein, 345 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 193 - protein, 296 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 194 - protein, 440 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 195 - protein, 231 aa, Artificial Sequence; identical to SEQ ID NO: 52
  Description of Artificial Sequence: Synthetic polypeptide

SEQ ID NO: 196 - protein, 114 aa, Artificial Sequence; identical to SEQ ID NO: 2
  Description of Artificial Sequence: Synthetic polypeptide

SEQ ID NO: 197 - protein, 231 aa, Artificial Sequence; identical to SEQ ID NO: 53
  Description of Artificial Sequence: Synthetic polypeptide

SEQ ID NO: 198 - protein, 296 aa, Artificial Sequence; identical to SEQ ID NO: 193
  Description of Artificial Sequence: Synthetic polypeptide

SEQ ID NO: 199 - protein, 114 aa, Artificial Sequence; identical to SEQ ID NO: 2
  Description of Artificial Sequence: Synthetic polypeptide

SEQ ID NO: 200 - protein, 231 aa, Artificial Sequence; identical to SEQ ID NO: 53
  Description of Artificial Sequence: Synthetic polypeptide

SEQ ID NO: 201 - protein, 301 aa, Artificial Sequence; identical to SEQ ID NO: 191
  Description of Artificial Sequence: Synthetic polypeptide

SEQ ID NO: 202 - protein, 114 aa, Artificial Sequence; identical to SEQ ID NO: 2
  Description of Artificial Sequence: Synthetic polypeptide

SEQ ID NO: 203 - protein, 296 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 204 - protein, 231 aa, Artificial Sequence; identical to SEQ ID NO: 52
  Description of Artificial Sequence: Synthetic polypeptide

SEQ ID NO: 205 - protein, 296 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 206 - protein, 114 aa, Artificial Sequence; identical to SEQ ID NO: 2
  Description of Artificial Sequence: Synthetic polypeptide

SEQ ID NO: 207 - protein, 415 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSITCPPPMSVEHADIWVKSYSLYSRERYICNSGFKRKAGTSSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 208 - protein, 306 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 209 - protein, 231 aa, Artificial Sequence; identical to SEQ ID NO: 77
  Description of Artificial Sequence: Synthetic polypeptide

SEQ ID NO: 210 - protein, 114 aa, Artificial Sequence; identical to SEQ ID NO: 2
  Description of Artificial Sequence: Synthetic polypeptide

SEQ ID NO: 211 - protein, 425 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 212 - protein, 231 aa, Artificial Sequence; identical to SEQ ID NO: 77
  Description of Artificial Sequence: Synthetic polypeptide

SEQ ID NO: 213 - protein, 66 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRD

SEQ ID NO: 214 - protein, 67 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDP

SEQ ID NO: 215 - protein, 68 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPA

SEQ ID NO: 216 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTS

SEQ ID NO: 217 - protein, 114 aa, Artificial Sequence
  Description of Artificial Sequence: Synthetic polypeptide
NWVNVISDLKKIEDLIQSMHIDATLYTESDVHPSCKVTAMKCFLLELQCISLESGDASIHDTVENLIILANNSLSSNGNVTESGCKECEELEEKNIKEFLQSFVHIVQMFINTS

SEQ ID NO: 218 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTS

SEQ ID NO: 219 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECCELEEKNIKEFLQSFVHIVQMFINTS

SEQ ID NO: 220 - protein, 114 aa, Artificial Sequence
  Description of Artificial Sequence: Synthetic polypeptide
NWVNVISDLKKIEDLIQSMHIDATLYTESDVHPSCKVTAMKCFLLELCVISLESGDASIHDTVENLIILANNSLSSNGNVTESGCKECEELEEKNIKEFLQSFVHIVQMFINTS

SEQ ID NO: 221 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLCSGDASIHDTVENLIILANNSLSSNGNVTESGCKECEELEEKNIKEFLQSFVHIVQMFINTS

SEQ ID NO: 222 - protein, 114 aa, Artificial Sequence
  Description of Artificial Sequence: Synthetic polypeptide
NWVNVISDLKKIEDLIQSMHIDATLYTESDVHPSCKVTAMKSFLLELQVISLESGDASIHDTVENLIILANNSLSSNGNVTESGCKECEELEEKNIKEFLQSFVHIVQMFINTS

SEQ ID NO: 223 - protein, 114 aa, Artificial Sequence
  Description of Artificial Sequence: Synthetic polypeptide
NWVNVISDLKKIEDLIQSMHIDATLYTESDVHPSCKVTAMKCFLCELQVISLESGDASIHDTVENLIILANNSLSSNGNVTESGCKECEELEEKNIKEFLQSFVHIVQMFINTS

SEQ ID NO: 224 - protein, 67 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDC

SEQ ID NO: 225 - protein, 68 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPC

SEQ ID NO: 226 - protein, 68 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCA

SEQ ID NO: 227 - protein, 65 aa, Artificial Sequence
  Description of Artificial Sequence: Synthetic polypeptide
ITCPPPMSVEHADIWVKSYSLYSRERYICNSGFKRKAGTCSLTECVLNKATNVAHWTTPSLKCIR

SEQ ID NO: 228 - protein, 65 aa, Artificial Sequence
  Description of Artificial Sequence: Synthetic polypeptide
ITCPPPMSVEHADIWVKSYSLYSRERYICNSGFCRKAGTSSLTECVLNKATNVAHWTTPSLKCIR

SEQ ID NO: 229 - protein, 65 aa, Artificial Sequence
  Description of Artificial Sequence: Synthetic polypeptide
ITCPPPMSVEHADIWVKSYSLYSRERYICNSGFKRKACTSSLTECVLNKATNVAHWTTPSLKCIR

SEQ ID NO: 230 - protein, 65 aa, Artificial Sequence
  Description of Artificial Sequence: Synthetic polypeptide
ITCPPPMSVEHADIWVKSYSLYSRERYICNSGFKRKAGTSSCTECVLNKATNVAHWTTPSLKCIR

SEQ ID NO: 231 - protein, 65 aa, Artificial Sequence
  Description of Artificial Sequence: Synthetic polypeptide
ITCPPPMSVEHADIWVKSYSLYSRERYICNSGFKRKCGTSSLTECVLNKATNVAHWTTPSLKCIR

SEQ ID NO: 232 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKCCEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 233 - protein, 303 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 234 - protein, 350 aa, Artificial Sequence; identical to SEQ ID NO: 232
  Description of Artificial Sequence: Synthetic polypeptide

SEQ ID NO: 235 - protein, 304 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPCGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 236 - protein, 350 aa, Artificial Sequence; identical to SEQ ID NO: 232
  Description of Artificial Sequence: Synthetic polypeptide

SEQ ID NO: 237 - protein, 304 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCAGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISCESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 239 - protein, 301 aa, Artificial Sequence
  Description of Artificial Sequence: Synthetic polypeptide
ITCPPPMSVEHADIWVKSYSLYSRERYICNSGFKRKAGTCSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 114 aa, Artificial Sequence; identical to SEQ ID NO: 216
  Description of Artificial Sequence: Synthetic polypeptide

SEQ ID NO: 241 - protein, 231 aa, Artificial Sequence; identical to SEQ ID NO: 53
  Description of Artificial Sequence: Synthetic polypeptide

SEQ ID NO: 242 - protein, 304 aa, Artificial Sequence; identical to SEQ ID NO: 235
  Description of Artificial Sequence: Synthetic polypeptide

SEQ ID NO: 243 - protein, 114 aa, Artificial Sequence; identical to SEQ ID NO: 216
  Description of Artificial Sequence: Synthetic polypeptide

SEQ ID NO: 244 - protein, 231 aa, Artificial Sequence; identical to SEQ ID NO: 53
  Description of Artificial Sequence: Synthetic polypeptide

SEQ ID NO: 245 - protein, 304 aa, Artificial Sequence; identical to SEQ ID NO: 237
  Description of Artificial Sequence: Synthetic polypeptide

SEQ ID NO: 246 - protein, 114 aa, Artificial Sequence; identical to SEQ ID NO: 218
  Description of Artificial Sequence: Synthetic polypeptide

SEQ ID NO: 247 - protein, 231 aa, Artificial Sequence; identical to SEQ ID NO: 53
  Description of Artificial Sequence: Synthetic polypeptide

SEQ ID NO: 248 - protein, 301 aa, Artificial Sequence; identical to SEQ ID NO: 239
  Description of Artificial Sequence: Synthetic polypeptide

SEQ ID NO: 249 - protein, 114 aa, Artificial Sequence; identical to SEQ ID NO: 216
  Description of Artificial Sequence: Synthetic polypeptide

SEQ ID NO: 250 - protein, 299 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 251 - protein, 298 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 252 - protein, 114 aa, Artificial Sequence; identical to SEQ ID NO: 216
  Description of Artificial Sequence: Synthetic polypeptide

SEQ ID NO: 253 - protein, 299 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCAEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 254 - protein, 114 aa, Artificial Sequence; identical to SEQ ID NO: 216
  Description of Artificial Sequence: Synthetic polypeptide

SEQ ID NO: 255 - protein, 296 aa, Artificial Sequence
  Description of Artificial Sequence: Synthetic polypeptide
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 256 - protein, 114 aa, Artificial Sequence; identical to SEQ ID NO: 218
  Description of Artificial Sequence: Synthetic polypeptide

SEQ ID NO: 257 - protein, 308 aa, Artificial Sequence
  Description of Artificial Sequence: Synthetic polypeptide
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 258 - protein, 231 aa, Artificial Sequence; identical to SEQ ID NO: 77
  Description of Artificial Sequence: Synthetic polypeptide

SEQ ID NO: 259 - protein, 114 aa, Artificial Sequence; identical to SEQ ID NO: 216
  Description of Artificial Sequence: Synthetic polypeptide

SEQ ID NO: 260 - protein, 114 aa, Artificial Sequence; identical to SEQ ID NO: 216
  Description of Artificial Sequence: Synthetic polypeptide

SEQ ID NO: 261 - protein, 231 aa, Artificial Sequence; identical to SEQ ID NO: 53
  Description of Artificial Sequence: Synthetic polypeptide

SEQ ID NO: 262 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 263 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 264 - protein, 114 aa, Artificial Sequence
  Description of Artificial Sequence: Synthetic polypeptide
NWVNVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 265 - protein, 114 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTS

SEQ ID NO: 266 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 267 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 268 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 269 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 270 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 271 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 272 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 273 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 274 - protein, 114 aa, Artificial Sequence
  Description of Artificial Sequence: Synthetic polypeptide
NWVNVISNLKKIEDLIQSMHIDATLYTESDVHPSCKVTAMKCFLLELQVISLESGDASIHNTVENLIILANNSLSSNGNVTESGCKECEELEEKNIKEFLQSFVHIVQMFINTS

SEQ ID NO: 275 - protein, 114 aa, Artificial Sequence
  Description of Artificial Sequence: Synthetic polypeptide
NWVNVISNLKKIEDLIQSMHIDATLYTESDVHPSCKVTAMKCFLLELQVISLESGDASIHDTVQNLIILANNSLSSNGNVTESGCKECEELEEKNIKEFLQSFVHIVQMFINTS

SEQ ID NO: 276 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVQMFINTS

SEQ ID NO: 277 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVQNLIILANNSLSSNGNVTESGCKECEELEEKNIKEFLQSFVHIVEMFINTS

SEQ ID NO: 278 - protein, 114 aa, Artificial Sequence
  Description of Artificial Sequence: Synthetic polypeptide
DWVDVISNLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 279 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHNTVQDLIILANNSLSSNGNVTESGCKECEELEEKNIKEFLQSFVHIVQMFINTS

SEQ ID NO: 280 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 281 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHNTVQNLIILANNSLSSNGNVTESGCKECEELEEKNIKEFLQSFVHIVEMFINTS

SEQ ID NO: 282 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 283 - protein, 114 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTS

SEQ ID NO: 284 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 285 - protein, 114 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTS

SEQ ID NO: 286 - protein, 114 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVEMFINTS

SEQ ID NO: 287 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTS

SEQ ID NO: 288 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVQDLIILANNSLSSNGNVTESGCKECEELEEKNIKEFLQSFVHIVQMFINTS

SEQ ID NO: 289 - protein, 114 aa, Artificial Sequence
  Description of Artificial Sequence: Synthetic polypeptide
DWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 290 - protein, 114 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTS

SEQ ID NO: 291 - protein, 114 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHNTVEDLIILANNSLSSNGNVTESGCKECEELEEKNIKEFLQSFVHIVQMFINTS

SEQ ID NO: 292 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 293 - protein, 301 aa, Artificial Sequence; identical to SEQ ID NO: 191
  Description of Artificial Sequence: Synthetic polypeptide

SEQ ID NO: 294 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 295 - protein, 301 aa, Artificial Sequence; identical to SEQ ID NO: 191
  Description of Artificial Sequence: Synthetic polypeptide

SEQ ID NO: 296 - protein, 350 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 297 - protein, 301 aa, Artificial Sequence; identical to SEQ ID NO: 191
  Description of Artificial Sequence: Synthetic polypeptide

SEQ ID NO: 298 - protein, 350 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 299 - protein, 301 aa, Artificial Sequence; identical to SEQ ID NO: 191
  Description of Artificial Sequence: Synthetic polypeptide

SEQ ID NO: 300 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVEMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 301 - protein, 301 aa, Artificial Sequence; identical to SEQ ID NO: 191
  Description of Artificial Sequence: Synthetic polypeptide

SEQ ID NO: 302 - protein, 345 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 303 - protein, 296 aa, Artificial Sequence; identical to SEQ ID NO: 193
  Description of Artificial Sequence: Synthetic polypeptide

SEQ ID NO: 304 - protein, 345 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 305 - protein, 296 aa, Artificial Sequence; identical to SEQ ID NO: 193
  Description of Artificial Sequence: Synthetic polypeptide

SEQ ID NO: 306 - protein, 350 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 307 - protein, 301 aa, Artificial Sequence; identical to SEQ ID NO: 191
  Description of Artificial Sequence: Synthetic polypeptide

SEQ ID NO: 308 - protein, 345 aa, Artificial Sequence
  Description of Artificial Sequence: Synthetic polypeptide
DWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 296 aa, Artificial Sequence; identical to SEQ ID NO: 193
  Description of Artificial Sequence: Synthetic polypeptide

SEQ ID NO: 310 - protein, 345 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 311 - protein, 296 aa, Artificial Sequence; identical to SEQ ID NO: 193
  Description of Artificial Sequence: Synthetic polypeptide

SEQ ID NO: 312 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 313 - protein, 231 aa, Artificial Sequence; identical to SEQ ID NO: 52
  Description of Artificial Sequence: Synthetic polypeptide

SEQ ID NO: 314 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 315 - protein, 231 aa, Artificial Sequence; identical to SEQ ID NO: 52
  Description of Artificial Sequence: Synthetic polypeptide

SEQ ID NO: 316 - protein, 440 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 317 - protein, 231 aa, Artificial Sequence; identical to SEQ ID NO: 52
  Description of Artificial Sequence: Synthetic polypeptide

SEQ ID NO: 318 - protein, 440 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 319 - protein, 231 aa, Artificial Sequence; identical to SEQ ID NO: 52
  Description of Artificial Sequence: Synthetic polypeptide

SEQ ID NO: 320 - protein, 445 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 321 - protein, 231 aa, Artificial Sequence; identical to SEQ ID NO: 52
  Description of Artificial Sequence: Synthetic polypeptide

SEQ ID NO: 322 - protein, 445 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 323 - protein, 231 aa, Artificial Sequence; identical to SEQ ID NO: 52
  Description of Artificial Sequence: Synthetic polypeptide

SEQ ID NO: 324 - protein, 440 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDPALVHQRPAPPGGGGSGGGGSGGGGSGGGNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVEMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 325 - protein, 231 aa, Artificial Sequence; identical to SEQ ID NO: 52
  Description of Artificial Sequence: Synthetic polypeptide

SEQ ID NO: 326 - protein, 296 aa, Artificial Sequence; identical to SEQ ID NO: 203
  Description of Artificial Sequence: Synthetic polypeptide

SEQ ID NO: 327 - protein, 231 aa, Artificial Sequence; identical to SEQ ID NO: 52
  Description of Artificial Sequence: Synthetic polypeptide

SEQ ID NO: 328 - protein, 114 aa, Artificial Sequence; identical to SEQ ID NO: 269
  Description of Artificial Sequence: Synthetic polypeptide

SEQ ID NO: 329 - protein, 296 aa, Artificial Sequence; identical to SEQ ID NO: 203
  Description of Artificial Sequence: Synthetic polypeptide

SEQ ID NO: 330 - protein, 296 aa, Artificial Sequence; identical to SEQ ID NO: 203
  Description of Artificial Sequence: Synthetic polypeptide

SEQ ID NO: 331 - protein, 231 aa, Artificial Sequence; identical to SEQ ID NO: 52
  Description of Artificial Sequence: Synthetic polypeptide

SEQ ID NO: 332 - protein, 114 aa, Artificial Sequence; identical to SEQ ID NO: 290
  Description of Artificial Sequence: Synthetic polypeptide

SEQ ID NO: 333 - protein, 296 aa, Artificial Sequence; identical to SEQ ID NO: 203
  Description of Artificial Sequence: Synthetic polypeptide

SEQ ID NO: 334 - protein, 231 aa, Artificial Sequence; identical to SEQ ID NO: 52
  Description of Artificial Sequence: Synthetic polypeptide

SEQ ID NO: 335 - protein, 114 aa, Artificial Sequence; identical to SEQ ID NO: 268
  Description of Artificial Sequence: Synthetic polypeptide

SEQ ID NO: 336 - protein, 65 aa, Artificial Sequence; identical to SEQ ID NO: 4
  Description of Artificial Sequence: Synthetic polypeptide

SEQ ID NO: 337 - protein, 114 aa, Artificial Sequence; identical to SEQ ID NO: 269
  Description of Artificial Sequence: Synthetic polypeptide

SEQ ID NO: 338 - protein, 65 aa, Artificial Sequence; identical to SEQ ID NO: 4
  Description of Artificial Sequence: Synthetic polypeptide

SEQ ID NO: 339 - protein, 296 aa, Artificial Sequence; identical to SEQ ID NO: 205
  Description of Artificial Sequence: Synthetic polypeptide

SEQ ID NO: 340 - protein, 114 aa, Artificial Sequence; identical to SEQ ID NO: 269
  Description of Artificial Sequence: Synthetic polypeptide

SEQ ID NO: 341 - protein, 231 aa, Artificial Sequence; identical to SEQ ID NO: 53
  Description of Artificial Sequence: Synthetic polypeptide

SEQ ID NO: 342 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVEDLIILANNSLSSNGNVTESGCKCCEELEEKNIKEFLQSFVHIVQMFINTS

SEQ ID NO: 343 - protein, 298 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRDCEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 344 - protein, 231 aa, Artificial Sequence; identical to SEQ ID NO: 53
  Description of Artificial Sequence: Synthetic polypeptide

SEQ ID NO: 345 - protein, 114 aa, Artificial Sequence
  Description of Artificial Sequence: Synthetic polypeptide
NWVNVISDLKKIEDLIQSMHIDATLYTESDVHPSCKVTAMKCFLLELQVISCESGDASIHDTVEDLIILANNSLSSNGNVTESGCKECEELEEKNIKEFLQSFVHIVQMFINTS

SEQ ID NO: 346 - protein, 296 aa, Artificial Sequence
  Description of Artificial Sequence: Synthetic polypeptide
ITCPPPMSVEHADIWVKSYSLYSRERYICNSGFKRKAGTCSLTECVLNKATNVAHWTTPSLKCIREPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 347 - protein, 440 aa, Artificial Sequence; identical to SEQ ID NO: 194
  Description of Artificial Sequence: Synthetic polypeptide

SEQ ID NO: 348 - protein, 480 aa, Artificial Sequence
  Description of Artificial Sequence: Synthetic polypeptide
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 349 - protein, 480 aa, Artificial Sequence
  Description of Artificial Sequence: Synthetic polypeptide
EIVLTQSPATLSASPGERVTLTCRASQSVGNDVAWYQQKPGQAPRLLINYASHRYTGVPDRFTGSGYGTEFTLTISSVQSEDFGVYYCQQDFSSPRTFGGGTKVEIKGKPGSGKPGSGKPGSGKPGSEVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGRGTLVTVSSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 350 - protein, 326 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 351 - protein, 114 aa, Artificial Sequence; identical to SEQ ID NO: 2
  Description of Artificial Sequence: Synthetic polypeptide

SEQ ID NO: 352 - protein, 480 aa, Artificial Sequence; identical to SEQ ID NO: 349
  Description of Artificial Sequence: Synthetic polypeptide

SEQ ID NO: 353 - protein, 299 aa, Artificial Sequence; identical to SEQ ID NO: 250
  Description of Artificial Sequence: Synthetic polypeptide

SEQ ID NO: 354 - protein, 114 aa, Artificial Sequence; identical to SEQ ID NO: 216
  Description of Artificial Sequence: Synthetic polypeptide

SEQ ID NO: 355 - protein, 440 aa, Artificial Sequence; identical to SEQ ID NO: 194
  Description of Artificial Sequence: Synthetic polypeptide

SEQ ID NO: 356 - protein, 451 aa, Artificial Sequence
  Description of Artificial Sequence: Synthetic polypeptide
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 357 - protein, 214 aa, Artificial Sequence
  Description of Artificial Sequence: Synthetic polypeptide
EIVMTQSPATLSVSPGERVTLTCRASQSVGNDVAWYQQKPGQSPRLLINYASHRYTGVPDRFTGSGYGTEFTLTISSVQSEDFAVYFCQQDFSSPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 358 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 359 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 360 - protein, 219 aa, Artificial Sequence; identical to SEQ ID NO: 183
  Description of Artificial Sequence: Synthetic polypeptide

SEQ ID NO: 361 - protein, 446 aa, Artificial Sequence; identical to SEQ ID NO: 358
  Description of Artificial Sequence: Synthetic polypeptide

SEQ ID NO: 362 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 363 - protein, 219 aa, Artificial Sequence; identical to SEQ ID NO: 183
  Description of Artificial Sequence: Synthetic polypeptide

SEQ ID NO: 364 - protein, 446 aa, Artificial Sequence; identical to SEQ ID NO: 358
  Description of Artificial Sequence: Synthetic polypeptide

SEQ ID NO: 365 - protein, 435 aa, Artificial Sequence; identical to SEQ ID NO: 312
  Description of Artificial Sequence: Synthetic polypeptide

SEQ ID NO: 366 - protein, 219 aa, Artificial Sequence; identical to SEQ ID NO: 183
  Description of Artificial Sequence: Synthetic polypeptide

SEQ ID NO: 367 - protein, 446 aa, Artificial Sequence; identical to SEQ ID NO: 358
  Description of Artificial Sequence: Synthetic polypeptide

SEQ ID NO: 368 - protein, 435 aa, Artificial Sequence; identical to SEQ ID NO: 314
  Description of Artificial Sequence: Synthetic polypeptide

SEQ ID NO: 369 - protein, 219 aa, Artificial Sequence; identical to SEQ ID NO: 183
  Description of Artificial Sequence: Synthetic polypeptide

SEQ ID NO: 370 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 371 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 372 - protein, 219 aa, Artificial Sequence; identical to SEQ ID NO: 183
  Description of Artificial Sequence: Synthetic polypeptide

SEQ ID NO: 373 - protein, 114 aa, Artificial Sequence; identical to SEQ ID NO: 2
  Description of Artificial Sequence: Synthetic polypeptide

SEQ ID NO: 374 - protein, 451 aa, Artificial Sequence
  Description of Artificial Sequence: Synthetic polypeptide
EVQLVESGGGLVKPGGSLRLSCVASGFTFSNYWMNWVRQAPGKGLEWVAEIRLYSNNYATHYAESVKGRFTISRDDSKSTLYLQMNNLKTEDTGVYYCTRYYGNYGGYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 375 - protein, 296 aa, Artificial Sequence; identical to SEQ ID NO: 193
  Description of Artificial Sequence: Synthetic polypeptide

SEQ ID NO: 376 - protein, 214 aa, Artificial Sequence; identical to SEQ ID NO: 357
  Description of Artificial Sequence: Synthetic polypeptide

SEQ ID NO: 377 - protein, 114 aa, Artificial Sequence; identical to SEQ ID NO: 216
  Description of Artificial Sequence: Synthetic polypeptide

SEQ ID NO: 378 - protein, 451 aa, Artificial Sequence; identical to SEQ ID NO: 374
  Description of Artificial Sequence: Synthetic polypeptide

SEQ ID NO: 379 - protein, 298 aa, Artificial Sequence; identical to SEQ ID NO: 343
  Description of Artificial Sequence: Synthetic polypeptide

SEQ ID NO: 380 - protein, 214 aa, Artificial Sequence; identical to SEQ ID NO: 357
  Description of Artificial Sequence: Synthetic polypeptide

SEQ ID NO: 381 - protein, 659 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTS

SEQ ID NO: 382 - protein, 446 aa, Artificial Sequence; identical to SEQ ID NO: 358
  Description of Artificial Sequence: Synthetic polypeptide

SEQ ID NO: 383 - protein, 219 aa, Artificial Sequence; identical to SEQ ID NO: 183
  Description of Artificial Sequence: Synthetic polypeptide

SEQ ID NO: 384 - protein, 660 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 385 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 386 - protein, 219 aa, Artificial Sequence; identical to SEQ ID NO: 183
  Description of Artificial Sequence: Synthetic polypeptide

SEQ ID NO: 387 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 388 - protein, 660 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTS

SEQ ID NO: 389 - protein, 219 aa, Artificial Sequence; identical to SEQ ID NO: 183
  Description of Artificial Sequence: Synthetic polypeptide

SEQ ID NO: 390 - protein, 114 aa, Artificial Sequence; identical to SEQ ID NO: 2
  Description of Artificial Sequence: Synthetic polypeptide

SEQ ID NO: 391 - protein, 517 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 392 - protein, 442 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 393 - protein, 214 aa, Artificial Sequence
  Description of Artificial Sequence: Synthetic polypeptide
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 394 - protein, 114 aa, Artificial Sequence; identical to SEQ ID NO: 2
  Description of Artificial Sequence: Synthetic polypeptide

SEQ ID NO: 395 - protein, 442 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 396 - protein, 517 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIR

SEQ ID NO: 397 - protein, 214 aa, Artificial Sequence; identical to SEQ ID NO: 393
  Description of Artificial Sequence: Synthetic polypeptide

SEQ ID NO: 398 - protein, 114 aa, Artificial Sequence; identical to SEQ ID NO: 216
  Description of Artificial Sequence: Synthetic polypeptide

SEQ ID NO: 399 - protein, 519 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 400 - protein, 442 aa, Artificial Sequence; identical to SEQ ID NO: 392
  Description of Artificial Sequence: Synthetic polypeptide

SEQ ID NO: 401 - protein, 214 aa, Artificial Sequence; identical to SEQ ID NO: 393
  Description of Artificial Sequence: Synthetic polypeptide

SEQ ID NO: 402 - protein, 114 aa, Artificial Sequence; identical to SEQ ID NO: 216
  Description of Artificial Sequence: Synthetic polypeptide

SEQ ID NO: 403 - protein, 442 aa, Artificial Sequence; identical to SEQ ID NO: 395
  Description of Artificial Sequence: Synthetic polypeptide

SEQ ID NO: 404 - protein, 519 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSITCPPPMSVEHADIWVKSYSLYSRERYICNSGFKRKAGTSSLTECVLNKATNVAHWTTPSLKCIRDC

SEQ ID NO: 405 - protein, 214 aa, Artificial Sequence; identical to SEQ ID NO: 393
  Description of Artificial Sequence: Synthetic polypeptide

SEQ ID NO: 406 - protein, 580 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 407 - protein, 531 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - protein, 219 aa, Artificial Sequence; identical to SEQ ID NO: 183
  Description of Artificial Sequence: Synthetic polypeptide

SEQ ID NO: 409 - protein, 665 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGGSGGGGSITCPPPMSVEHADIWVKSYSLYSRERYICNSGFKRKAGTSSLTECVLNKATNVAHWTTPSLKCIRGGGGSGGGGSGGGGSGGGGSGGGGSNWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 410 - protein, 446 aa, Artificial Sequence; identical to SEQ ID NO: 358
  Description of Artificial Sequence: Synthetic polypeptide

SEQ ID NO: 411 - protein, 219 aa, Artificial Sequence; identical to SEQ ID NO: 183
  Description of Artificial Sequence: Synthetic polypeptide

SEQ ID NO: 412 - protein, 442 aa, Artificial Sequence
  Description of Artificial Sequence: Synthetic polypeptide
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 413 - protein, 214 aa, Artificial Sequence; identical to SEQ ID NO: 393
  Description of Artificial Sequence: Synthetic polypeptide

SEQ ID NO: 414 - protein, 231 aa, Artificial Sequence; identical to SEQ ID NO: 53
  Description of Artificial Sequence: Synthetic polypeptide

SEQ ID NO: 415 - protein, 446 aa, Artificial Sequence; identical to SEQ ID NO: 358
  Description of Artificial Sequence: Synthetic polypeptide

SEQ ID NO: 416 - protein, 219 aa, Artificial Sequence; identical to SEQ ID NO: 183
  Description of Artificial Sequence: Synthetic polypeptide

SEQ ID NO: 417 - protein, 250 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFFSGVPDRFSGSGSGTDFTLTISSLQAEDVAVYYCFQGSHVPNTFGGGTKVEIK

SEQ ID NO: 418 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 419 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 420 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLSVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 421 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERVTINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 422 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCRSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 423 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKASQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 424 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 425 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQAPKLLIYKVSNRFSGVPDRFSGSGSGTDFTLTISSLQAEDVAVYYCFQGSHVPNTFGGGTKVEIK

SEQ ID NO: 426 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSLQAEDVAVYYCFQGSHVPNTFGGGTKVEIK

SEQ ID NO: 427 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIK

SEQ ID NO: 428 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSMQAEDVAVYYCFQGSHVPNTFGGGTKVEIK

SEQ ID NO: 429 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVQAEDVAVYYCFQGSHVPNTFGGGTKVEIK

SEQ ID NO: 430 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDAAVYYCFQGSHVPNTFGGGTKVEIK

SEQ ID NO: 431 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIK

SEQ ID NO: 432 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGQGTKVEIK

SEQ ID NO: 433 - protein, 249 aa, Artificial Sequence
  Description of Artificial Sequence: Synthetic polypeptide
QVQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 434 - protein, 249 aa, Artificial Sequence
  Description of Artificial Sequence: Synthetic polypeptide
QIQLVQSGAELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 435 - protein, 249 aa, Artificial Sequence
  Description of Artificial Sequence: Synthetic polypeptide
QIQLVQSGPELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 436 - protein, 249 aa, Artificial Sequence
  Description of Artificial Sequence: Synthetic polypeptide
QIQLVQSGSELKKPGASVKVSCKASGYTFTHYGMNWVKQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 437 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTNTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 438 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 439 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 440 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 441 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRVVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 442 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSADTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 443 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 444 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTIYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 445 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 446 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGKSPKLLIYKVSNRFSGVPDRFSGSGSGTDFTLTISSLQAEDVAVYYCFQGSHVPNTFGGGTKVEIK

SEQ ID NO: 447 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGIPDRFSGSGSGTDFTLTISSLQAEDVAVYYCFQGSHVPNTFGGGTKVEIK

SEQ ID NO: 448 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPARFSGSGSGTDFTLTISSLQAEDVAVYYCFQGSHVPNTFGGGTKVEIK

SEQ ID NO: 449 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 450 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGPGTKVEIK

SEQ ID NO: 451 - protein, 249 aa, Artificial Sequence
  Description of Artificial Sequence: Synthetic polypeptide
QIQLVQSGPELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 452 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTNTGEPTYADGFTGRFVFSVDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 453 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 454 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFQGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 455 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTNTGEPTYADGFTGRFVFSVDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 456 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFKGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 457 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFQGRFVFSLDTSQSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 458 - protein, 249 aa, Artificial Sequence
  Description of Artificial Sequence: Synthetic polypeptide
EIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 459 - protein, 249 aa, Artificial Sequence
  Description of Artificial Sequence: Synthetic polypeptide
QIQLVQSGSVLKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 460 - protein, 249 aa, Artificial Sequence
  Description of Artificial Sequence: Synthetic polypeptide
QIQLVQSGSELVKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 461 - protein, 249 aa, Artificial Sequence
  Description of Artificial Sequence: Synthetic polypeptide
QIQLVQSGSELKKPGGSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 462 - protein, 249 aa, Artificial Sequence
  Description of Artificial Sequence: Synthetic polypeptide
QIQLVQSGSELKKPGQSVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 463 - protein, 249 aa, Artificial Sequence
  Description of Artificial Sequence: Synthetic polypeptide
QIQLVQSGSELKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 464 - protein, 249 aa, Artificial Sequence
  Description of Artificial Sequence: Synthetic polypeptide
QIQLVQSGSELKKPGASVKVSCKASGYTFTHYGINWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 465 - protein, 249 aa, Artificial Sequence
  Description of Artificial Sequence: Synthetic polypeptide
QIQLVQSGSELKKPGASVKVSCKASGYTFTHYGMNWVRQPPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 466 - protein, 249 aa, Artificial Sequence
  Description of Artificial Sequence: Synthetic polypeptide
QIQLVQSGSELKKPGASVKVSCKASGYTFTHYGMNWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 467 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTKTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 468 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPYYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 469 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAPGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 470 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYATGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 471 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAQKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 472 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 473 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 474 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVNTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 475 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVDTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 476 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 477 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKPEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 478 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFTGVPDRFSGSGSGTDFTLTISSVQAEDVATYYCFQGSHVPNTFGQGTKVEIK

SEQ ID NO: 479 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSLQAEDVAVYYCFQGSHVPNTFGGGTKVEIK

SEQ ID NO: 480 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 481 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 482 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIK

SEQ ID NO: 483 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIK

SEQ ID NO: 484 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLPVTPGEPATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 485 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTINSLQAEDAATYYCHQGSHVPNTFGGGTKVEIK

SEQ ID NO: 486 - protein, 249 aa, Artificial Sequence
  Description of Artificial Sequence: Synthetic polypeptide
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 487 - protein, 249 aa, Artificial Sequence
  Description of Artificial Sequence: Synthetic polypeptide
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDILMTQSPDSLAVSLGERATINCKSSQSIVHSNGNTYLEWYQQKPGQSPKLLIYKVSNRFTGVPDRFSGSGSGTDFTLTISSVQAEDAATYYCFQGSHVPNTFGQGTKVEIK

SEQ ID NO: 488 - protein, 249 aa, Artificial Sequence
  Description of Artificial Sequence: Synthetic polypeptide
QIQLVQSGPELKKPGASVKVSCKASGYTFTHYGMNWVKQAPGQGLEWMGWINTNTGEPTYADKFTGRVVFSLDTSQSTIYLQISSLKAEDTAVYYCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFTGVPDRFSGSGSGTDFTLTISSVQAEDAATYYCFQGSHVPNTFGQGTKVEIK

SEQ ID NO: 489 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 490 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 491 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERVTINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 492 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSMQAEDAATYYCFQGSHVPNTFGQGTKVEIK

SEQ ID NO: 493 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVQAEDAATYYCFQGSHVPNTFGQGTKVEIK

SEQ ID NO: 494 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERITINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 495 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVVMTQSPDSLAVSLGERATINCKASQSIVHSNGNTYLEWYQQKPGQPPKLLIYKVSNRFSGIPDRFSGSGSGTDFTLTISSVQAEDAATYYCFQGSHVPNTFGQGTKVEIK

SEQ ID NO: 496 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 497 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 498 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERATINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 499 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAPGFKGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 500 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAPKFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 501 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAPGFKERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 502 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYAPKFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 503 - protein, 249 aa, Artificial Sequence
  Description of Artificial Sequence: Synthetic polypeptide
QIQLVQSGSELKKPGASVKVSCKASGYTFTHYGINWVRQAPGQGLEWMGWINTYTGEPTYADGFTGRFVFSVDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 504 - protein, 249 aa, Artificial Sequence
  Description of Artificial Sequence: Synthetic polypeptide
QIQLVQSGSELKKPGASVKVSCKASGYTFTHYGINWVRQAPGQGLEWMGWINTYTGEPTYADGFTGRFVFSIDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 505 - protein, 249 aa, Artificial Sequence
  Description of Artificial Sequence: Synthetic polypeptide
QIQLVQSGSELVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 506 - protein, 249 aa, Artificial Sequence
  Description of Artificial Sequence: Synthetic polypeptide
QIQLVQSGSVLKKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 507 - protein, 249 aa, Artificial Sequence
  Description of Artificial Sequence: Synthetic polypeptide
QIQLVQSGSVLVKPGESVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 508 - protein, 249 aa, Artificial Sequence
  Description of Artificial Sequence: Synthetic polypeptide
EVQLVQSGSELVKPGESVKVSCKASGYTFTHYGINWVRQPPGQGLEWIGWINTYTGEPYYAPKFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 509 - protein, 249 aa, Artificial Sequence
  Description of Artificial Sequence: Synthetic polypeptide
EVQLVQSGSELVKPGESVKVSCKASGYTFTHYGINWVRQPPGQGLEWMGWINTYTGEPYYAPGFTERFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 510 - protein, 249 aa, Artificial Sequence
  Description of Artificial Sequence: Synthetic polypeptide
QVQLVQSGSELVKPGESVKVSCKASGYTFTHYGINWVRQPPGQGLEWMGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 511 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 512 - protein, 249 aa, Artificial Sequence
  Description of Artificial Sequence: Synthetic polypeptide
QVQLVQSGSELKKPGASVKVSCKASGYTFTHYGINWVRQPPGQGLEWIGWINTYTGEPYYAPKFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 513 - protein, 249 aa, Artificial Sequence
  Description of Artificial Sequence: Synthetic polypeptide
QVQLVQSGSVLKKPGGSVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 514 - protein, 249 aa, Artificial Sequence
  Description of Artificial Sequence: Synthetic polypeptide
QVQLVQSGSELVKPGESVKVSCKASGYTFTHYGMNWVRQAPGQGLEWMGWINTYTGEPTYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 515 - protein, 249 aa, Artificial Sequence
  Description of Artificial Sequence: Synthetic polypeptide
EVQLVQSGSVLKKPGESVKVSCKASGYTFTHYGINWVRQAPGQGLEWMGWINTYTGEPTYADGFTERFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 516 - protein, 249 aa, Artificial Sequence
  Description of Artificial Sequence: Synthetic polypeptide
QIQLVQSGSELKKPGASVKVSCKASGYTFTHYGMNWVRQPPGQGLEWIGWINTYTGEPTYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 517 - protein, 249 aa, Artificial Sequence
  Description of Artificial Sequence: Synthetic polypeptide
EIQLVQSGSVLKKPGASVKVSCKASGYTFTHYGINWVRQAPGQGLEWIGWINTYTGEPTYADGFTGRFVFSLDTSVSTAYLQISSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 518 - protein, 249 aa, Artificial Sequence
  Description of Artificial Sequence: Synthetic polypeptide
QIQLVQSGSELKKPGASVKVSCKASGYTFTHYGMNWVRQPPGQGLEWMGWINTYTGEPYYADGFTGRFVFSLDTSVDTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 519 - protein, 249 aa, Artificial Sequence
  Description of Artificial Sequence: Synthetic polypeptide
EVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 520 - protein, 249 aa, Artificial Sequence
  Description of Artificial Sequence: Synthetic polypeptide
QVQLVQSGSELKKPGASVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 521 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYADGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 522 - protein, 249 aa, Artificial Sequence
  Description of Artificial Sequence: Synthetic polypeptide
QVQLVQSGSELKKPGESVKVSCKASGYTFTHYGMNWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 523 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQSTAYLQINSLKAEDTAVYFCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 524 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 525 - protein, 249 aa, Artificial Sequence
  Description of Artificial Sequence: Synthetic polypeptide
QVQLVQSGSELKKPGESVKVSCKASGYTFTHYGINWVRQAPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 526 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 527 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFQGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 528 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFKGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 529 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPTYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 530 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 531 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 532 - protein, 249 aa, Artificial Sequence
  Description of Artificial Sequence: Synthetic polypeptide
QVQLVQSGSELKKPGESVKVSCKASGYTFTHYGINWVRQPPGQGLEWMGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 533 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 534 - protein, 249 aa, Artificial Sequence
  Description of Artificial Sequence: Synthetic polypeptide
QVQLVQSGPELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 535 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSVDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 536 - protein, 249 aa, Artificial Sequence
  Description of Artificial Sequence: Synthetic polypeptide
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 537 - protein, 249 aa, Artificial Sequence
  Description of Artificial Sequence: Synthetic polypeptide
QVQLVQSGPELKKPGESVKVSCKASGYTFTHYGINWVRQAPGQGLEWIGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 538 - protein, 249 aa, Artificial Sequence
  Description of Artificial Sequence: Synthetic polypeptide
QVQLVQSGPELKKPGESVKVSCKASGYTFTHYGINWVRQAPGQGLEWIGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 539 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 540 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTGRFVFSLDTSVSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 541 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 542 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 543 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFKERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 544 - protein, 249 aa, Artificial Sequence
  Description of Artificial Sequence: Synthetic polypeptide
EIQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 545 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDVATYYCFQGSHVPNTFGQGTKVEIK

SEQ ID NO: 546 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 547 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQSPKLLIYKVSNRFSGVPDRFSGSGSGTDFTLTISSVEAEDVATYYCFQGSHVPNTFGQGTKVEIK

SEQ ID NO: 548 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQSPKLLIYKVSNRFSGVPDRFSGSGSGTDFTLTISSVEAEDAATYYCFQGSHVPNTFGQGTKVEIK

SEQ ID NO: 549 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDVATYYCFQGSHVPNTFGQGTKVEIK

SEQ ID NO: 550 - protein, 249 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 551 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPTYAPGFTGRFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 552 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 553 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 554 - protein, 249 aa, Artificial Sequence
  Description of Artificial Sequence: Synthetic polypeptide
QVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 555 - protein, 249 aa, Artificial Sequence
  Description of Artificial Sequence: Synthetic polypeptide
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 556 - protein, 249 aa, Artificial Sequence
  Description of Artificial Sequence: Synthetic polypeptide
EVQLVQSGPELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 557 - protein, 249 aa, Artificial Sequence
  Description of Artificial Sequence: Synthetic polypeptide
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 558 - protein, 249 aa, Artificial Sequence
  Description of Artificial Sequence: Synthetic polypeptide
QVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 559 - protein, 249 aa, Artificial Sequence
  Description of Artificial Sequence: Synthetic polypeptide
QVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 560 - protein, 249 aa, Artificial Sequence
  Description of Artificial Sequence: Synthetic polypeptide
QVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 561 - protein, 249 aa, Artificial Sequence
  Description of Artificial Sequence: Synthetic polypeptide
QVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 562 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 563 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 564 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPTYAPGFTGRFVFSLDTSQSTAYLQISSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 565 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPTYAPGFTGRFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 566 - protein, 249 aa, Artificial Sequence
  Description of Artificial Sequence: Synthetic polypeptide
QVQLVQSGSELKKPGESVKVSCKASGYTFTHYGINWVRQAPGQGLEWMGWINTYTGEPYYAPGFTERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 567 - protein, 249 aa, Artificial Sequence
  Description of Artificial Sequence: Synthetic polypeptide
QVQLVQSGSELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 568 - protein, 249 aa, Artificial Sequence
  Description of Artificial Sequence: Synthetic polypeptide
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 569 - protein, 249 aa, Artificial Sequence
  Description of Artificial Sequence: Synthetic polypeptide
QVQLVQSGPELKKPGESVKVSCKASGYTFTHYGINWVRQAPGQGLEWIGWINTYTGEPYYAPGFTGRFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 570 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 571 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFTGRFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 572 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 573 - protein, 249 aa, Artificial Sequence
  Description of Artificial Sequence: Synthetic polypeptide
QVQLVQSGSELKKPGESVKVSCKASGYTFTHYGINWVRQPPGQGLEWIGWINTYTGEPYYAPGFTGRFVFSLDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 574 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 575 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 576 - protein, 249 aa, Artificial Sequence
  Description of Artificial Sequence: Synthetic polypeptide
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 577 - protein, 249 aa, Artificial Sequence
  Description of Artificial Sequence: Synthetic polypeptide
EVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 578 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 579 - protein, 249 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 580 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 581 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 582 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 583 - protein, 249 aa, Artificial Sequence; identical to SEQ ID NO: 580
  Description of Artificial Sequence: Synthetic polypeptide

SEQ ID NO: 584 - protein, 249 aa, Artificial Sequence; identical to SEQ ID NO: 581
  Description of Artificial Sequence: Synthetic polypeptide

SEQ ID NO: 585 - protein, 249 aa, Artificial Sequence; identical to SEQ ID NO: 582
  Description of Artificial Sequence: Synthetic polypeptide

SEQ ID NO: 586 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 587 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 588 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIK

SEQ ID NO: 589 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQSTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 590 - protein, 249 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 591 - protein, 249 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSGKPGSGKPGSGKPGSGKPGSDIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 592 - protein, 446 aa, Artificial Sequence; identical to SEQ ID NO: 170
  Description of Artificial Sequence: Synthetic polypeptide

SEQ ID NO: 593 - protein, 446 aa, Artificial Sequence
  Description of Artificial Sequence: Synthetic polypeptide
QVQLVQSGPELKKPGESVKVSCKASGYTFTHYGINWVRQAPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 594 - protein, 446 aa, Artificial Sequence; identical to SEQ ID NO: 593
  Description of Artificial Sequence: Synthetic polypeptide

SEQ ID NO: 595 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 596 - protein, 446 aa, Artificial Sequence; identical to SEQ ID NO: 595
  Description of Artificial Sequence: Synthetic polypeptide

SEQ ID NO: 597 - protein, 446 aa, Artificial Sequence; identical to SEQ ID NO: 595
  Description of Artificial Sequence: Synthetic polypeptide

SEQ ID NO: 598 - protein, 446 aa, Artificial Sequence; identical to SEQ ID NO: 595
  Description of Artificial Sequence: Synthetic polypeptide

SEQ ID NO: 599 - protein, 446 aa, Artificial Sequence; identical to SEQ ID NO: 595
  Description of Artificial Sequence: Synthetic polypeptide

SEQ ID NO: 600 - protein, 446 aa, Artificial Sequence; identical to SEQ ID NO: 595
  Description of Artificial Sequence: Synthetic polypeptide

SEQ ID NO: 601 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 602 - protein, 446 aa, Artificial Sequence; identical to SEQ ID NO: 601
  Description of Artificial Sequence: Synthetic polypeptide

SEQ ID NO: 603 - protein, 446 aa, Artificial Sequence; identical to SEQ ID NO: 601
  Description of Artificial Sequence: Synthetic polypeptide

SEQ ID NO: 604 - protein, 446 aa, Artificial Sequence; identical to SEQ ID NO: 601
  Description of Artificial Sequence: Synthetic polypeptide

SEQ ID NO: 605 - protein, 446 aa, Artificial Sequence; identical to SEQ ID NO: 601
  Description of Artificial Sequence: Synthetic polypeptide

SEQ ID NO: 606 - protein, 446 aa, Artificial Sequence; identical to SEQ ID NO: 601
  Description of Artificial Sequence: Synthetic polypeptide

SEQ ID NO: 607 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGDPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 608 - protein, 446 aa, Artificial Sequence; identical to SEQ ID NO: 607
  Description of Artificial Sequence: Synthetic polypeptide

SEQ ID NO: 609 - protein, 446 aa, Artificial Sequence; identical to SEQ ID NO: 607
  Description of Artificial Sequence: Synthetic polypeptide

SEQ ID NO: 610 - protein, 446 aa, Artificial Sequence; identical to SEQ ID NO: 607
  Description of Artificial Sequence: Synthetic polypeptide

SEQ ID NO: 611 - protein, 446 aa, Artificial Sequence; identical to SEQ ID NO: 607
  Description of Artificial Sequence: Synthetic polypeptide

SEQ ID NO: 612 - protein, 446 aa, Artificial Sequence; identical to SEQ ID NO: 607
  Description of Artificial Sequence: Synthetic polypeptide

SEQ ID NO: 613 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDNSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 614 - protein, 446 aa, Artificial Sequence; identical to SEQ ID NO: 613
  Description of Artificial Sequence: Synthetic polypeptide

SEQ ID NO: 615 - protein, 446 aa, Artificial Sequence; identical to SEQ ID NO: 613
  Description of Artificial Sequence: Synthetic polypeptide

SEQ ID NO: 616 - protein, 446 aa, Artificial Sequence; identical to SEQ ID NO: 613
  Description of Artificial Sequence: Synthetic polypeptide

SEQ ID NO: 617 - protein, 446 aa, Artificial Sequence; identical to SEQ ID NO: 613
  Description of Artificial Sequence: Synthetic polypeptide

SEQ ID NO: 618 - protein, 446 aa, Artificial Sequence; identical to SEQ ID NO: 613
  Description of Artificial Sequence: Synthetic polypeptide

SEQ ID NO: 619 - protein, 446 aa, Artificial Sequence
  Description of Artificial Sequence: Synthetic polypeptide
QIQLVQSGSELKKPGASVKVSCKASTYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 620 - protein, 446 aa, Artificial Sequence
  Description of Artificial Sequence: Synthetic polypeptide
QIQLVQSGSELKKPGASVKVSCKASGDTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 621 - protein, 446 aa, Artificial Sequence
  Description of Artificial Sequence: Synthetic polypeptide
QIQLVQSGSELKKPGASVKVSCKASGKTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 622 - protein, 446 aa, Artificial Sequence
  Description of Artificial Sequence: Synthetic polypeptide
QIQLVQSGSELKKPGASVKVSCKASGYTWTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 446 aa, Artificial Sequence
  Description of Artificial Sequence: Synthetic polypeptide
QIQLVQSGSELKKPGASVKVSCKASGYTFVHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 624 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 625 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 626 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 446 aa, Artificial Sequence; identical to SEQ ID NO: 170
  Description of Artificial Sequence: Synthetic polypeptide

SEQ ID NO: 628 - protein, 446 aa, Artificial Sequence; identical to SEQ ID NO: 170
  Description of Artificial Sequence: Synthetic polypeptide

SEQ ID NO: 629 - protein, 446 aa, Artificial Sequence; identical to SEQ ID NO: 170
  Description of Artificial Sequence: Synthetic polypeptide

SEQ ID NO: 630 - protein, 446 aa, Artificial Sequence; identical to SEQ ID NO: 170
  Description of Artificial Sequence: Synthetic polypeptide

SEQ ID NO: 631 - protein, 446 aa, Artificial Sequence; identical to SEQ ID NO: 170
  Description of Artificial Sequence: Synthetic polypeptide

SEQ ID NO: 632 - protein, 446 aa, Artificial Sequence; identical to SEQ ID NO: 170
  Description of Artificial Sequence: Synthetic polypeptide

SEQ ID NO: 633 - protein, 446 aa, Artificial Sequence; identical to SEQ ID NO: 170
  Description of Artificial Sequence: Synthetic polypeptide

SEQ ID NO: 634 - protein, 446 aa, Artificial Sequence; identical to SEQ ID NO: 170
  Description of Artificial Sequence: Synthetic polypeptide

SEQ ID NO: 635 - protein, 446 aa, Artificial Sequence; identical to SEQ ID NO: 170
  Description of Artificial Sequence: Synthetic polypeptide

SEQ ID NO: 636 - protein, 446 aa, Artificial Sequence; identical to SEQ ID NO: 170
  Description of Artificial Sequence: Synthetic polypeptide

SEQ ID NO: 637 - protein, 446 aa, Artificial Sequence; identical to SEQ ID NO: 170
  Description of Artificial Sequence: Synthetic polypeptide

SEQ ID NO: 638 - protein, 446 aa, Artificial Sequence; identical to SEQ ID NO: 170
  Description of Artificial Sequence: Synthetic polypeptide

SEQ ID NO: 639 - protein, 446 aa, Artificial Sequence; identical to SEQ ID NO: 170
  Description of Artificial Sequence: Synthetic polypeptide

SEQ ID NO: 640 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTSEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 641 - protein, 446 aa, Artificial Sequence; identical to SEQ ID NO: 595
  Description of Artificial Sequence: Synthetic polypeptide

SEQ ID NO: 642 - protein, 446 aa, Artificial Sequence; identical to SEQ ID NO: 626
  Description of Artificial Sequence: Synthetic polypeptide

SEQ ID NO: 643 - protein, 446 aa, Artificial Sequence; identical to SEQ ID NO: 640
  Description of Artificial Sequence: Synthetic polypeptide

SEQ ID NO: 644 - protein, 446 aa, Artificial Sequence; identical to SEQ ID NO: 595
  Description of Artificial Sequence: Synthetic polypeptide

SEQ ID NO: 645 - protein, 446 aa, Artificial Sequence; identical to SEQ ID NO: 626
  Description of Artificial Sequence: Synthetic polypeptide

SEQ ID NO: 646 - protein, 446 aa, Artificial Sequence; identical to SEQ ID NO: 626
  Description of Artificial Sequence: Synthetic polypeptide

SEQ ID NO: 647 - protein, 446 aa, Artificial Sequence; identical to SEQ ID NO: 640
  Description of Artificial Sequence: Synthetic polypeptide

SEQ ID NO: 648 - protein, 446 aa, Artificial Sequence; identical to SEQ ID NO: 595
  Description of Artificial Sequence: Synthetic polypeptide

SEQ ID NO: 649 - protein, 446 aa, Artificial Sequence; identical to SEQ ID NO: 601
  Description of Artificial Sequence: Synthetic polypeptide

SEQ ID NO: 650 - protein, 446 aa, Artificial Sequence; identical to SEQ ID NO: 640
  Description of Artificial Sequence: Synthetic polypeptide

SEQ ID NO: 651 - protein, 446 aa, Artificial Sequence; identical to SEQ ID NO: 170
  Description of Artificial Sequence: Synthetic polypeptide

SEQ ID NO: 652 - protein, 446 aa, Artificial Sequence; identical to SEQ ID NO: 170
  Description of Artificial Sequence: Synthetic polypeptide

SEQ ID NO: 653 - protein, 446 aa, Artificial Sequence; identical to SEQ ID NO: 170
  Description of Artificial Sequence: Synthetic polypeptide

SEQ ID NO: 654 - protein, 446 aa, Artificial Sequence; identical to SEQ ID NO: 170
  Description of Artificial Sequence: Synthetic polypeptide

SEQ ID NO: 655 - protein, 446 aa, Artificial Sequence; identical to SEQ ID NO: 640
  Description of Artificial Sequence: Synthetic polypeptide

SEQ ID NO: 656 - protein, 446 aa, Artificial Sequence; identical to SEQ ID NO: 595
  Description of Artificial Sequence: Synthetic polypeptide

SEQ ID NO: 657 - protein, 446 aa, Artificial Sequence; identical to SEQ ID NO: 170
  Description of Artificial Sequence: Synthetic polypeptide

SEQ ID NO: 658 - protein, 446 aa, Artificial Sequence; identical to SEQ ID NO: 170
  Description of Artificial Sequence: Synthetic polypeptide

SEQ ID NO: 659 - protein, 446 aa, Artificial Sequence; identical to SEQ ID NO: 170
  Description of Artificial Sequence: Synthetic polypeptide

SEQ ID NO: 660 - protein, 446 aa, Artificial Sequence; identical to SEQ ID NO: 170
  Description of Artificial Sequence: Synthetic polypeptide

SEQ ID NO: 661 - protein, 446 aa, Artificial Sequence; identical to SEQ ID NO: 170
  Description of Artificial Sequence: Synthetic polypeptide

SEQ ID NO: 662 - protein, 446 aa, Artificial Sequence; identical to SEQ ID NO: 170
  Description of Artificial Sequence: Synthetic polypeptide

SEQ ID NO: 663 - protein, 446 aa, Artificial Sequence; identical to SEQ ID NO: 170
  Description of Artificial Sequence: Synthetic polypeptide

SEQ ID NO: 664 - protein, 446 aa, Artificial Sequence; identical to SEQ ID NO: 170
  Description of Artificial Sequence: Synthetic polypeptide

SEQ ID NO: 665 - protein, 446 aa, Artificial Sequence; identical to SEQ ID NO: 170
  Description of Artificial Sequence: Synthetic polypeptide

SEQ ID NO: 666 - protein, 446 aa, Artificial Sequence; identical to SEQ ID NO: 170
  Description of Artificial Sequence: Synthetic polypeptide

SEQ ID NO: 667 - protein, 446 aa, Artificial Sequence
  Description of Artificial Sequence: Synthetic polypeptide
QIQLVQSESELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 668 - protein, 446 aa, Artificial Sequence
  Description of Artificial Sequence: Synthetic polypeptide
QIQLVQSSSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 669 - protein, 446 aa, Artificial Sequence
  Description of Artificial Sequence: Synthetic polypeptide
QIQLVQSVSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 670 - protein, 446 aa, Artificial Sequence
  Description of Artificial Sequence: Synthetic polypeptide
QIQLVQSGSELTKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 671 - protein, 446 aa, Artificial Sequence
  Description of Artificial Sequence: Synthetic polypeptide
QIQLVQSGSELQKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 446 aa, Artificial Sequence
  Description of Artificial Sequence: Synthetic polypeptide
QIQLVQSGSELYKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 446 aa, Artificial Sequence
  Description of Artificial Sequence: Synthetic polypeptide
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 446 aa, Artificial Sequence
  Description of Artificial Sequence: Synthetic polypeptide
QIQLVQSGSELKKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 676 - protein, 446 aa, Artificial Sequence
  Description of Artificial Sequence: Synthetic polypeptide
QIQLVQSGSELVKPGASVTVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSQSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 678 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 679 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 680 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTSEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 681 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 683 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 684 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTHSGEPTYADGFTGRFVFSLDTSQSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 685 - protein, 446 aa, Artificial Sequence; identical to SEQ ID NO: 677
  Description of Artificial Sequence: Synthetic polypeptide

SEQ ID NO: 686 - protein, 446 aa, Artificial Sequence; identical to SEQ ID NO: 678
  Description of Artificial Sequence: Synthetic polypeptide

SEQ ID NO: 687 - protein, 446 aa, Artificial Sequence; identical to SEQ ID NO: 679
  Description of Artificial Sequence: Synthetic polypeptide

SEQ ID NO: 688 - protein, 446 aa, Artificial Sequence; identical to SEQ ID NO: 680
  Description of Artificial Sequence: Synthetic polypeptide

SEQ ID NO: 689 - protein, 446 aa, Artificial Sequence; identical to SEQ ID NO: 681
  Description of Artificial Sequence: Synthetic polypeptide

SEQ ID NO: 690 - protein, 446 aa, Artificial Sequence; identical to SEQ ID NO: 682
  Description of Artificial Sequence: Synthetic polypeptide

SEQ ID NO: 691 - protein, 446 aa, Artificial Sequence; identical to SEQ ID NO: 683
  Description of Artificial Sequence: Synthetic polypeptide

SEQ ID NO: 692 - protein, 446 aa, Artificial Sequence; identical to SEQ ID NO: 684
  Description of Artificial Sequence: Synthetic polypeptide

SEQ ID NO: 693 - protein, 446 aa, Artificial Sequence; identical to SEQ ID NO: 677
  Description of Artificial Sequence: Synthetic polypeptide

SEQ ID NO: 694 - protein, 446 aa, Artificial Sequence; identical to SEQ ID NO: 678
  Description of Artificial Sequence: Synthetic polypeptide

SEQ ID NO: 695 - protein, 446 aa, Artificial Sequence; identical to SEQ ID NO: 679
  Description of Artificial Sequence: Synthetic polypeptide

SEQ ID NO: 696 - protein, 446 aa, Artificial Sequence; identical to SEQ ID NO: 680
  Description of Artificial Sequence: Synthetic polypeptide

SEQ ID NO: 697 - protein, 446 aa, Artificial Sequence; identical to SEQ ID NO: 681
  Description of Artificial Sequence: Synthetic polypeptide

SEQ ID NO: 698 - protein, 446 aa, Artificial Sequence; identical to SEQ ID NO: 682
  Description of Artificial Sequence: Synthetic polypeptide

SEQ ID NO: 699 - protein, 446 aa, Artificial Sequence; identical to SEQ ID NO: 683
  Description of Artificial Sequence: Synthetic polypeptide

SEQ ID NO: 700 - protein, 446 aa, Artificial Sequence; identical to SEQ ID NO: 684
  Description of Artificial Sequence: Synthetic polypeptide

SEQ ID NO: 701 - protein, 446 aa, Artificial Sequence; identical to SEQ ID NO: 626
  Description of Artificial Sequence: Synthetic polypeptide

SEQ ID NO: 702 - protein, 446 aa, Artificial Sequence; identical to SEQ ID NO: 626
  Description of Artificial Sequence: Synthetic polypeptide

SEQ ID NO: 703 - protein, 446 aa, Artificial Sequence; identical to SEQ ID NO: 678
  Description of Artificial Sequence: Synthetic polypeptide

SEQ ID NO: 704 - protein, 446 aa, Artificial Sequence; identical to SEQ ID NO: 681
  Description of Artificial Sequence: Synthetic polypeptide

SEQ ID NO: 705 - protein, 446 aa, Artificial Sequence; identical to SEQ ID NO: 682
  Description of Artificial Sequence: Synthetic polypeptide

SEQ ID NO: 706 - protein, 446 aa, Artificial Sequence
  Description of Artificial Sequence: Synthetic polypeptide
QIQLVQSGSELLKPGASVKVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 707 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 708 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 709 - protein, 446 aa, Artificial Sequence
  Description of Artificial Sequence: Synthetic polypeptide
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 710 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 711 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 712 - protein, 446 aa, Artificial Sequence
  Description of Artificial Sequence: Synthetic polypeptide
QIQLVQSGSELLKPGASVKVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 713 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 714 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTHSGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 715 - protein, 446 aa, Artificial Sequence
  Description of Artificial Sequence: Synthetic polypeptide
QIQLVQSGSELLKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 716 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 717 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 718 - protein, 446 aa, Artificial Sequence; identical to SEQ ID NO: 706
  Description of Artificial Sequence: Synthetic polypeptide

SEQ ID NO: 719 - protein, 446 aa, Artificial Sequence; identical to SEQ ID NO: 707
  Description of Artificial Sequence: Synthetic polypeptide

SEQ ID NO: 720 - protein, 446 aa, Artificial Sequence; identical to SEQ ID NO: 708
  Description of Artificial Sequence: Synthetic polypeptide

SEQ ID NO: 721 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGYINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 722 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGETTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 723 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADKFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 446 aa, Artificial Sequence; identical to SEQ ID NO: 170
  Description of Artificial Sequence: Synthetic polypeptide

SEQ ID NO: 725 - protein, 446 aa, Artificial Sequence; identical to SEQ ID NO: 170
  Description of Artificial Sequence: Synthetic polypeptide

SEQ ID NO: 726 - protein, 446 aa, Artificial Sequence; identical to SEQ ID NO: 170
  Description of Artificial Sequence: Synthetic polypeptide

SEQ ID NO: 727 - protein, 446 aa, Artificial Sequence
  Description of Artificial Sequence: Synthetic polypeptide
QIQLVQSGSELKKPGASVKVSCKASGLTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 728 - protein, 446 aa, Artificial Sequence
  Description of Artificial Sequence: Synthetic polypeptide
QIQLVQSGSELKKPGASVKVSCKASGHTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 729 - protein, 446 aa, Artificial Sequence
  Description of Artificial Sequence: Synthetic polypeptide
QIQLVQSGSELKKPGASVKVSCKASGQTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 730 - protein, 446 aa, Artificial Sequence
  Description of Artificial Sequence: Synthetic polypeptide
QIQLVQSGSELKKPGASVKVSCKASGYQFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 731 - protein, 446 aa, Artificial Sequence
  Description of Artificial Sequence: Synthetic polypeptide
QIQLVQSGSELKKPGASVKVSCKASGYTFTQYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 732 - protein, 446 aa, Artificial Sequence
  Description of Artificial Sequence: Synthetic polypeptide
QIQLVQSGSELKKPGASVKVSCKASGYTFTDYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 733 - protein, 446 aa, Artificial Sequence
  Description of Artificial Sequence: Synthetic polypeptide
QIQLVQSGSELKKPGASVKVSCKASGYTFTRYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 734 - protein, 446 aa, Artificial Sequence
  Description of Artificial Sequence: Synthetic polypeptide
QIQLVQSGSELKKPGASVKVSCKASGYTFTHLGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 735 - protein, 446 aa, Artificial Sequence
  Description of Artificial Sequence: Synthetic polypeptide
QIQLVQSGSELKKPGASVKVSCKASGYTFTHYGMNWFRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 736 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWIQTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 737 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWIETYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 738 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWIHTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 739 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWISTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 740 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTLTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 741 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTWTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 742 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYIGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 743 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGKPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 744 - protein, 446 aa, Artificial Sequence; identical to SEQ ID NO: 170
  Description of Artificial Sequence: Synthetic polypeptide

SEQ ID NO: 745 - protein, 446 aa, Artificial Sequence; identical to SEQ ID NO: 170
  Description of Artificial Sequence: Synthetic polypeptide

SEQ ID NO: 746 - protein, 446 aa, Artificial Sequence; identical to SEQ ID NO: 170
  Description of Artificial Sequence: Synthetic polypeptide

SEQ ID NO: 747 - protein, 446 aa, Artificial Sequence; identical to SEQ ID NO: 170
  Description of Artificial Sequence: Synthetic polypeptide

SEQ ID NO: 748 - protein, 446 aa, Artificial Sequence; identical to SEQ ID NO: 170
  Description of Artificial Sequence: Synthetic polypeptide

SEQ ID NO: 749 - protein, 446 aa, Artificial Sequence; identical to SEQ ID NO: 170
  Description of Artificial Sequence: Synthetic polypeptide

SEQ ID NO: 750 - protein, 446 aa, Artificial Sequence; identical to SEQ ID NO: 170
  Description of Artificial Sequence: Synthetic polypeptide

SEQ ID NO: 751 - protein, 446 aa, Artificial Sequence; identical to SEQ ID NO: 170
  Description of Artificial Sequence: Synthetic polypeptide

SEQ ID NO: 752 - protein, 446 aa, Artificial Sequence; identical to SEQ ID NO: 170
  Description of Artificial Sequence: Synthetic polypeptide

SEQ ID NO: 753 - protein, 446 aa, Artificial Sequence; identical to SEQ ID NO: 170
  Description of Artificial Sequence: Synthetic polypeptide

SEQ ID NO: 754 - protein, 446 aa, Artificial Sequence; identical to SEQ ID NO: 170
  Description of Artificial Sequence: Synthetic polypeptide

SEQ ID NO: 755 - protein, 446 aa, Artificial Sequence; identical to SEQ ID NO: 170
  Description of Artificial Sequence: Synthetic polypeptide

SEQ ID NO: 756 - protein, 446 aa, Artificial Sequence; identical to SEQ ID NO: 595
  Description of Artificial Sequence: Synthetic polypeptide

SEQ ID NO: 757 - protein, 446 aa, Artificial Sequence
  Description of Artificial Sequence: Synthetic polypeptide
QIQLVQSGSELKKPGASVKVSCKASAYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 758 - protein, 446 aa, Artificial Sequence
  Description of Artificial Sequence: Synthetic polypeptide
QIQLVQSGSELKKPGASVKVSCKASSYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 759 - protein, 446 aa, Artificial Sequence; identical to SEQ ID NO: 619
  Description of Artificial Sequence: Synthetic polypeptide

SEQ ID NO: 760 - protein, 446 aa, Artificial Sequence
  Description of Artificial Sequence: Synthetic polypeptide
QIQLVQSGSELKKPGASVKVSCKASGWTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 761 - protein, 446 aa, Artificial Sequence; identical to SEQ ID NO: 727
  Description of Artificial Sequence: Synthetic polypeptide

SEQ ID NO: 762 - protein, 446 aa, Artificial Sequence; identical to SEQ ID NO: 728
  Description of Artificial Sequence: Synthetic polypeptide

SEQ ID NO: 763 - protein, 446 aa, Artificial Sequence; identical to SEQ ID NO: 729
  Description of Artificial Sequence: Synthetic polypeptide

SEQ ID NO: 764 - protein, 446 aa, Artificial Sequence; identical to SEQ ID NO: 620
  Description of Artificial Sequence: Synthetic polypeptide

SEQ ID NO: 765 - protein, 446 aa, Artificial Sequence; identical to SEQ ID NO: 621
  Description of Artificial Sequence: Synthetic polypeptide

SEQ ID NO: 766 - protein, 446 aa, Artificial Sequence
  Description of Artificial Sequence: Synthetic polypeptide
QIQLVQSGSELKKPGASVKVSCKASGYVFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 767 - protein, 446 aa, Artificial Sequence
  Description of Artificial Sequence: Synthetic polypeptide
QIQLVQSGSELKKPGASVKVSCKASGYAFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 768 - protein, 446 aa, Artificial Sequence
  Description of Artificial Sequence: Synthetic polypeptide
QIQLVQSGSELKKPGASVKVSCKASGYIFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 769 - protein, 446 aa, Artificial Sequence; identical to SEQ ID NO: 730
  Description of Artificial Sequence: Synthetic polypeptide

SEQ ID NO: 770 - protein, 446 aa, Artificial Sequence
  Description of Artificial Sequence: Synthetic polypeptide
QIQLVQSGSELKKPGASVKVSCKASGYTYTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 771 - protein, 446 aa, Artificial Sequence; identical to SEQ ID NO: 622
  Description of Artificial Sequence: Synthetic polypeptide

SEQ ID NO: 772 - protein, 446 aa, Artificial Sequence
  Description of Artificial Sequence: Synthetic polypeptide
QIQLVQSGSELKKPGASVKVSCKASGYTHTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 773 - protein, 446 aa, Artificial Sequence; identical to SEQ ID NO: 623
  Description of Artificial Sequence: Synthetic polypeptide

SEQ ID NO: 774 - protein, 446 aa, Artificial Sequence
  Description of Artificial Sequence: Synthetic polypeptide
QIQLVQSGSELKKPGASVKVSCKASGYTFAHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 775 - protein, 446 aa, Artificial Sequence
  Description of Artificial Sequence: Synthetic polypeptide
QIQLVQSGSELKKPGASVKVSCKASGYTFIHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 776 - protein, 446 aa, Artificial Sequence
  Description of Artificial Sequence: Synthetic polypeptide
QIQLVQSGSELKKPGASVKVSCKASGYTFQHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 777 - protein, 446 aa, Artificial Sequence
  Description of Artificial Sequence: Synthetic polypeptide
QIQLVQSGSELKKPGASVKVSCKASGYTFTYYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 778 - protein, 446 aa, Artificial Sequence; identical to SEQ ID NO: 731
  Description of Artificial Sequence: Synthetic polypeptide

SEQ ID NO: 779 - protein, 446 aa, Artificial Sequence; identical to SEQ ID NO: 732
  Description of Artificial Sequence: Synthetic polypeptide

SEQ ID NO: 780 - protein, 446 aa, Artificial Sequence; identical to SEQ ID NO: 733
  Description of Artificial Sequence: Synthetic polypeptide

SEQ ID NO: 781 - protein, 446 aa, Artificial Sequence
  Description of Artificial Sequence: Synthetic polypeptide
QIQLVQSGSELKKPGASVKVSCKASGYTFTFYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 782 - protein, 446 aa, Artificial Sequence
  Description of Artificial Sequence: Synthetic polypeptide
QIQLVQSGSELKKPGASVKVSCKASGYTFTHFGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 783 - protein, 446 aa, Artificial Sequence
  Description of Artificial Sequence: Synthetic polypeptide
QIQLVQSGSELKKPGASVKVSCKASGYTFTHHGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 784 - protein, 446 aa, Artificial Sequence; identical to SEQ ID NO: 734
  Description of Artificial Sequence: Synthetic polypeptide

SEQ ID NO: 785 - protein, 446 aa, Artificial Sequence
  Description of Artificial Sequence: Synthetic polypeptide
QIQLVQSGSELKKPGASVKVSCKASGYTFTHWGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 786 - protein, 446 aa, Artificial Sequence
  Description of Artificial Sequence: Synthetic polypeptide
QIQLVQSGSELKKPGASVKVSCKASGYTFTHYTMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 787 - protein, 446 aa, Artificial Sequence
  Description of Artificial Sequence: Synthetic polypeptide
QIQLVQSGSELKKPGASVKVSCKASGYTFTHYQMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 788 - protein, 446 aa, Artificial Sequence
  Description of Artificial Sequence: Synthetic polypeptide
QIQLVQSGSELKKPGASVKVSCKASGYTFTHYGLNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 789 - protein, 446 aa, Artificial Sequence
  Description of Artificial Sequence: Synthetic polypeptide
QIQLVQSGSELKKPGASVKVSCKASGYTFTHYGMNWLRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 790 - protein, 446 aa, Artificial Sequence
  Description of Artificial Sequence: Synthetic polypeptide
QIQLVQSGSELKKPGASVKVSCKASGYTFTHYGMNWTRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 791 - protein, 446 aa, Artificial Sequence; identical to SEQ ID NO: 735
  Description of Artificial Sequence: Synthetic polypeptide

SEQ ID NO: 792 - protein, 446 aa, Artificial Sequence
  Description of Artificial Sequence: Synthetic polypeptide
QIQLVQSGSELKKPGASVKVSCKASGYTFTHYGMNWVRQAPGQGLEWMTWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 793 - protein, 446 aa, Artificial Sequence
  Description of Artificial Sequence: Synthetic polypeptide
QIQLVQSGSELKKPGASVKVSCKASGYTFTHYGMNWVRQAPGQGLEWMDWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 794 - protein, 446 aa, Artificial Sequence
  Description of Artificial Sequence: Synthetic polypeptide
QIQLVQSGSELKKPGASVKVSCKASGYTFTHYGMNWVRQAPGQGLEWMQWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 795 - protein, 446 aa, Artificial Sequence
  Description of Artificial Sequence: Synthetic polypeptide
QIQLVQSGSELKKPGASVKVSCKASGYTFTHYGMNWVRQAPGQGLEWMEWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 796 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGFINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 797 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGHINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 798 - protein, 446 aa, Artificial Sequence; identical to SEQ ID NO: 736
  Description of Artificial Sequence: Synthetic polypeptide

SEQ ID NO: 799 - protein, 446 aa, Artificial Sequence; identical to SEQ ID NO: 737
  Description of Artificial Sequence: Synthetic polypeptide

SEQ ID NO: 800 - protein, 446 aa, Artificial Sequence; identical to SEQ ID NO: 738
  Description of Artificial Sequence: Synthetic polypeptide

SEQ ID NO: 801 - protein, 446 aa, Artificial Sequence; identical to SEQ ID NO: 739
  Description of Artificial Sequence: Synthetic polypeptide

SEQ ID NO: 802 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTFTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 803 - protein, 446 aa, Artificial Sequence; identical to SEQ ID NO: 624
  Description of Artificial Sequence: Synthetic polypeptide

SEQ ID NO: 804 - protein, 446 aa, Artificial Sequence; identical to SEQ ID NO: 740
  Description of Artificial Sequence: Synthetic polypeptide

SEQ ID NO: 805 - protein, 446 aa, Artificial Sequence; identical to SEQ ID NO: 741
  Description of Artificial Sequence: Synthetic polypeptide

SEQ ID NO: 806 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYVGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 807 - protein, 446 aa, Artificial Sequence; identical to SEQ ID NO: 625
  Description of Artificial Sequence: Synthetic polypeptide

SEQ ID NO: 808 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYAGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 809 - protein, 446 aa, Artificial Sequence; identical to SEQ ID NO: 742
  Description of Artificial Sequence: Synthetic polypeptide

SEQ ID NO: 810 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGQPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 811 - protein, 446 aa, Artificial Sequence; identical to SEQ ID NO: 743
  Description of Artificial Sequence: Synthetic polypeptide

SEQ ID NO: 812 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDFYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 813 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDQYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 814 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDHYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 815 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDRYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 816 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDKYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 817 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYWGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 818 - protein, 446 aa, Artificial Sequence; identical to SEQ ID NO: 626
  Description of Artificial Sequence: Synthetic polypeptide

SEQ ID NO: 819 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYASSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 820 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYSSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 821 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 822 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 823 - protein, 219 aa, Artificial Sequence; identical to SEQ ID NO: 183
  Description of Artificial Sequence: Synthetic polypeptide

SEQ ID NO: 824 - protein, 219 aa, Artificial Sequence
  Description of Artificial Sequence: Synthetic polypeptide
DVLMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 825 - protein, 219 aa, Artificial Sequence
  Description of Artificial Sequence: Synthetic polypeptide
DVLMTQSPDSLAVSLGERATINCKSSQSIVYSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 826 - protein, 219 aa, Artificial Sequence
  Description of Artificial Sequence: Synthetic polypeptide
DVLMTQSPDSLAVSLGERATINCKSSQSIVQSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 827 - protein, 219 aa, Artificial Sequence
  Description of Artificial Sequence: Synthetic polypeptide
DVLMTQSPDSLAVSLGERATINCKSSQSIVDSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 828 - protein, 219 aa, Artificial Sequence
  Description of Artificial Sequence: Synthetic polypeptide
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 829 - protein, 219 aa, Artificial Sequence
  Description of Artificial Sequence: Synthetic polypeptide
DVLMTQSPDSLAVSLGERATINCKSSQSIVTSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 830 - protein, 219 aa, Artificial Sequence
  Description of Artificial Sequence: Synthetic polypeptide
DVLMTQSPDSLAVSLGERATINCKSSQSIVKSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 831 - protein, 219 aa, Artificial Sequence
  Description of Artificial Sequence: Synthetic polypeptide
DVLMTQSPDSLAVSLGERATINCKSSQSIVHTNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 832 - protein, 219 aa, Artificial Sequence
  Description of Artificial Sequence: Synthetic polypeptide
DVLMTQSPDSLAVSLGERATINCKSSQSIVHANGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 833 - protein, 219 aa, Artificial Sequence
  Description of Artificial Sequence: Synthetic polypeptide
DVLMTQSPDSLAVSLGERATINCKSSQSIVHQNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 834 - protein, 219 aa, Artificial Sequence
  Description of Artificial Sequence: Synthetic polypeptide
DVLMTQSPDSLAVSLGERATINCKSSQSIVHGNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 835 - protein, 219 aa, Artificial Sequence
  Description of Artificial Sequence: Synthetic polypeptide
DVLMTQSPDSLAVSLGERATINCKSSQSIVHVNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 836 - protein, 219 aa, Artificial Sequence
  Description of Artificial Sequence: Synthetic polypeptide
DVLMTQSPDSLAVSLGERATINCKSSQSIVHSHGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 837 - protein, 219 aa, Artificial Sequence
  Description of Artificial Sequence: Synthetic polypeptide
DVLMTQSPDSLAVSLGERATINCKSSQSIVHSEGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 838 - protein, 219 aa, Artificial Sequence
  Description of Artificial Sequence: Synthetic polypeptide
DVLMTQSPDSLAVSLGERATINCKSSQSIVHSSGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 839 - protein, 219 aa, Artificial Sequence
  Description of Artificial Sequence: Synthetic polypeptide
DVLMTQSPDSLAVSLGERATINCKSSQSIVHSRGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 840 - protein, 219 aa, Artificial Sequence
  Description of Artificial Sequence: Synthetic polypeptide
DVLMTQSPDSLAVSLGERATINCKSSQSIVHSLGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 841 - protein, 219 aa, Artificial Sequence
  Description of Artificial Sequence: Synthetic polypeptide
DVLMTQSPDSLAVSLGERATINCKSSQSIVHSNANTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 842 - protein, 219 aa, Artificial Sequence
  Description of Artificial Sequence: Synthetic polypeptide
DVLMTQSPDSLAVSLGERATINCKSSQSIVHSNSNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 843 - protein, 219 aa, Artificial Sequence
  Description of Artificial Sequence: Synthetic polypeptide
DVLMTQSPDSLAVSLGERATINCKSSQSIVHSNTNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 844 - protein, 219 aa, Artificial Sequence
  Description of Artificial Sequence: Synthetic polypeptide
DVLMTQSPDSLAVSLGERATINCKSSQSIVHSNQNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 845 - protein, 219 aa, Artificial Sequence
  Description of Artificial Sequence: Synthetic polypeptide
DVLMTQSPDSLAVSLGERATINCKSSQSIVHSNGDTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 846 - protein, 219 aa, Artificial Sequence
  Description of Artificial Sequence: Synthetic polypeptide
DVLMTQSPDSLAVSLGERATINCKSSQSIVHSNGHTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 847 - protein, 219 aa, Artificial Sequence
  Description of Artificial Sequence: Synthetic polypeptide
DVLMTQSPDSLAVSLGERATINCKSSQSIVHSNGETYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 848 - protein, 219 aa, Artificial Sequence
  Description of Artificial Sequence: Synthetic polypeptide
DVLMTQSPDSLAVSLGERATINCKSSQSIVHSNGRTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 849 - protein, 219 aa, Artificial Sequence
  Description of Artificial Sequence: Synthetic polypeptide
DVLMTQSPDSLAVSLGERATINCKSSQSIVHSNGNTFLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 850 - protein, 219 aa, Artificial Sequence
  Description of Artificial Sequence: Synthetic polypeptide
DVLMTQSPDSLAVSLGERATINCKSSQSIVHSNGNTHLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 851 - protein, 219 aa, Artificial Sequence
  Description of Artificial Sequence: Synthetic polypeptide
DVLMTQSPDSLAVSLGERATINCKSSQSIVHSNGNTLLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 852 - protein, 219 aa, Artificial Sequence
  Description of Artificial Sequence: Synthetic polypeptide
DVLMTQSPDSLAVSLGERATINCKSSQSIVHSNGNTWLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 853 - protein, 219 aa, Artificial Sequence
  Description of Artificial Sequence: Synthetic polypeptide
DVLMTQSPDSLAVSLGERATINCKSSQSIVHSNGNTQLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 854 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIFKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 855 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIHKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 856 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLILKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 857 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIWKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 858 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIQKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 859 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKISNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 860 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKLSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 861 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKSSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 862 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSDRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 863 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSHRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 864 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSERFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 865 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSRRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 866 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCMQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 867 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCEQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 868 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQASHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 869 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQSSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 870 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQDSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 871 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQTSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 872 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQQSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 873 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQHSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 874 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQLSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 875 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQRSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 876 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQFSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 877 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGTHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 878 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGAHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 879 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGQHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 880 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGVHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 881 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSYVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 882 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSQVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 883 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSDVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 884 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSFVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSTVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 886 - protein, 435 aa, Artificial Sequence; identical to SEQ ID NO: 314
  Description of Artificial Sequence: Synthetic polypeptide

SEQ ID NO: 887 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 888 - protein, 219 aa, Artificial Sequence
  Description of Artificial Sequence: Synthetic polypeptide
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 889 - protein, 435 aa, Artificial Sequence; identical to SEQ ID NO: 314
  Description of Artificial Sequence: Synthetic polypeptide

SEQ ID NO: 890 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 891 - protein, 219 aa, Artificial Sequence; identical to SEQ ID NO: 828
  Description of Artificial Sequence: Synthetic polypeptide

SEQ ID NO: 892 - protein, 435 aa, Artificial Sequence; identical to SEQ ID NO: 314
  Description of Artificial Sequence: Synthetic polypeptide

SEQ ID NO: 893 - protein, 446 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 894 - protein, 219 aa, Artificial Sequence
  Description of Artificial Sequence: Synthetic polypeptide
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 895 - protein, 435 aa, Artificial Sequence; identical to SEQ ID NO: 314
  Description of Artificial Sequence: Synthetic polypeptide

SEQ ID NO: 896 - protein, 446 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 897 - protein, 219 aa, Artificial Sequence; identical to SEQ ID NO: 183
  Description of Artificial Sequence: Synthetic polypeptide

SEQ ID NO: 898 - protein, 435 aa, Artificial Sequence; identical to SEQ ID NO: 314
  Description of Artificial Sequence: Synthetic polypeptide

SEQ ID NO: 899 - protein, 446 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 900 - protein, 219 aa, Artificial Sequence; identical to SEQ ID NO: 183
  Description of Artificial Sequence: Synthetic polypeptide

SEQ ID NO: 901 - protein, 435 aa, Artificial Sequence; identical to SEQ ID NO: 314
  Description of Artificial Sequence: Synthetic polypeptide

SEQ ID NO: 902 - protein, 446 aa, Artificial Sequence; identical to SEQ ID NO: 899
  Description of Artificial Sequence: Synthetic polypeptide

SEQ ID NO: 903 - protein, 219 aa, Artificial Sequence
  Description of Artificial Sequence: Synthetic polypeptide
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 904 - protein, 435 aa, Artificial Sequence; identical to SEQ ID NO: 314
  Description of Artificial Sequence: Synthetic polypeptide

SEQ ID NO: 905 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 906 - protein, 219 aa, Artificial Sequence; identical to SEQ ID NO: 828
  Description of Artificial Sequence: Synthetic polypeptide

SEQ ID NO: 907 - protein, 350 aa, Artificial Sequence
  Description of Artificial Sequence: Synthetic polypeptide
NWVNVISDLKKIEDLIQSMHIDATLYTESDVHPSCKVTAMKCFLLELQVISLESGDASIHDTVENLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 908 - protein, 301 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 909 - protein, 350 aa, Artificial Sequence
  Description of Artificial Sequence: Synthetic polypeptide
NWVDVISDLKKIEDLIQSMHIDATLYTESDVHPSCKVTAMKCFLLELQVISLESGDASIHDTVEDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 910 - protein, 301 aa, Artificial Sequence; identical to SEQ ID NO: 908
  Description of Artificial Sequence: Synthetic polypeptide

SEQ ID NO: 911 - protein, 435 aa, Artificial Sequence; identical to SEQ ID NO: 371
  Description of Artificial Sequence: Synthetic polypeptide

SEQ ID NO: 912 - protein, 231 aa, Artificial Sequence; identical to SEQ ID NO: 72
  Description of Artificial Sequence: Synthetic polypeptide

SEQ ID NO: 913 - protein, 350 aa, Artificial Sequence
  Description of Artificial Sequence: Synthetic polypeptide
NWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 914 - protein, 301 aa, Artificial Sequence; identical to SEQ ID NO: 908
  Description of Artificial Sequence: Synthetic polypeptide

SEQ ID NO: 915 - protein, 435 aa, Artificial Sequence; identical to SEQ ID NO: 359
  Description of Artificial Sequence: Synthetic polypeptide

SEQ ID NO: 916 - protein, 231 aa, Artificial Sequence; identical to SEQ ID NO: 52
  Description of Artificial Sequence: Synthetic polypeptide

SEQ ID NO: 917 - protein, 435 aa, Artificial Sequence; identical to SEQ ID NO: 314
  Description of Artificial Sequence: Synthetic polypeptide

SEQ ID NO: 918 - protein, 231 aa, Artificial Sequence; identical to SEQ ID NO: 52
  Description of Artificial Sequence: Synthetic polypeptide

SEQ ID NO: 919 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVENLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 920 - protein, 231 aa, Artificial Sequence; identical to SEQ ID NO: 52
  Description of Artificial Sequence: Synthetic polypeptide

SEQ ID NO: 921 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 922 - protein, 231 aa, Artificial Sequence; identical to SEQ ID NO: 52
  Description of Artificial Sequence: Synthetic polypeptide

SEQ ID NO: 923 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 924 - protein, 231 aa, Artificial Sequence; identical to SEQ ID NO: 52
  Description of Artificial Sequence: Synthetic polypeptide

SEQ ID NO: 925 - protein, 435 aa, Artificial Sequence; identical to SEQ ID NO: 921
  Description of Artificial Sequence: Synthetic polypeptide

SEQ ID NO: 926 - protein, 446 aa, Artificial Sequence; identical to SEQ ID NO: 358
  Description of Artificial Sequence: Synthetic polypeptide

SEQ ID NO: 927 - protein, 435 aa, Artificial Sequence; identical to SEQ ID NO: 921
  Description of Artificial Sequence: Synthetic polypeptide

SEQ ID NO: 928 - protein, 446 aa, Artificial Sequence; identical to SEQ ID NO: 887
  Description of Artificial Sequence: Synthetic polypeptide

SEQ ID NO: 929 - protein, 219 aa, Artificial Sequence; identical to SEQ ID NO: 888
  Description of Artificial Sequence: Synthetic polypeptide

SEQ ID NO: 930 - protein, 435 aa, Artificial Sequence; identical to SEQ ID NO: 921
  Description of Artificial Sequence: Synthetic polypeptide

SEQ ID NO: 931 - protein, 446 aa, Artificial Sequence; identical to SEQ ID NO: 890
  Description of Artificial Sequence: Synthetic polypeptide

SEQ ID NO: 932 - protein, 219 aa, Artificial Sequence; identical to SEQ ID NO: 828
  Description of Artificial Sequence: Synthetic polypeptide

SEQ ID NO: 933 - protein, 435 aa, Artificial Sequence; identical to SEQ ID NO: 921
  Description of Artificial Sequence: Synthetic polypeptide

SEQ ID NO: 934 - protein, 446 aa, Artificial Sequence; identical to SEQ ID NO: 893
  Description of Artificial Sequence: Synthetic polypeptide

SEQ ID NO: 935 - protein, 219 aa, Artificial Sequence; identical to SEQ ID NO: 894
  Description of Artificial Sequence: Synthetic polypeptide

SEQ ID NO: 936 - protein, 435 aa, Artificial Sequence; identical to SEQ ID NO: 921
  Description of Artificial Sequence: Synthetic polypeptide

SEQ ID NO: 937 - protein, 446 aa, Artificial Sequence; identical to SEQ ID NO: 896
  Description of Artificial Sequence: Synthetic polypeptide

SEQ ID NO: 938 - protein, 219 aa, Artificial Sequence; identical to SEQ ID NO: 183
  Description of Artificial Sequence: Synthetic polypeptide

SEQ ID NO: 939 - protein, 435 aa, Artificial Sequence; identical to SEQ ID NO: 921
  Description of Artificial Sequence: Synthetic polypeptide

SEQ ID NO: 940 - protein, 446 aa, Artificial Sequence; identical to SEQ ID NO: 899
  Description of Artificial Sequence: Synthetic polypeptide

SEQ ID NO: 941 - protein, 219 aa, Artificial Sequence; identical to SEQ ID NO: 183
  Description of Artificial Sequence: Synthetic polypeptide

SEQ ID NO: 942 - protein, 435 aa, Artificial Sequence; identical to SEQ ID NO: 921
  Description of Artificial Sequence: Synthetic polypeptide

SEQ ID NO: 943 - protein, 446 aa, Artificial Sequence; identical to SEQ ID NO: 899
  Description of Artificial Sequence: Synthetic polypeptide

SEQ ID NO: 944 - protein, 219 aa, Artificial Sequence; identical to SEQ ID NO: 903
  Description of Artificial Sequence: Synthetic polypeptide

SEQ ID NO: 945 - protein, 435 aa, Artificial Sequence; identical to SEQ ID NO: 921
  Description of Artificial Sequence: Synthetic polypeptide

SEQ ID NO: 946 - protein, 446 aa, Artificial Sequence; identical to SEQ ID NO: 905
  Description of Artificial Sequence: Synthetic polypeptide

SEQ ID NO: 947 - protein, 219 aa, Artificial Sequence; identical to SEQ ID NO: 828
  Description of Artificial Sequence: Synthetic polypeptide

SEQ ID NO: 948 - protein, 435 aa, Artificial Sequence; identical to SEQ ID NO: 923
  Description of Artificial Sequence: Synthetic polypeptide

SEQ ID NO: 949 - protein, 446 aa, Artificial Sequence; identical to SEQ ID NO: 358
  Description of Artificial Sequence: Synthetic polypeptide

SEQ ID NO: 950 - protein, 219 aa, Artificial Sequence; identical to SEQ ID NO: 183
  Description of Artificial Sequence: Synthetic polypeptide

SEQ ID NO: 951 - protein, 435 aa, Artificial Sequence; identical to SEQ ID NO: 923
  Description of Artificial Sequence: Synthetic polypeptide

SEQ ID NO: 952 - protein, 446 aa, Artificial Sequence; identical to SEQ ID NO: 887
  Description of Artificial Sequence: Synthetic polypeptide

SEQ ID NO: 953 - protein, 219 aa, Artificial Sequence; identical to SEQ ID NO: 888
  Description of Artificial Sequence: Synthetic polypeptide

SEQ ID NO: 954 - protein, 435 aa, Artificial Sequence; identical to SEQ ID NO: 923
  Description of Artificial Sequence: Synthetic polypeptide

SEQ ID NO: 955 - protein, 446 aa, Artificial Sequence; identical to SEQ ID NO: 890
  Description of Artificial Sequence: Synthetic polypeptide

SEQ ID NO: 956 - protein, 219 aa, Artificial Sequence; identical to SEQ ID NO: 828
  Description of Artificial Sequence: Synthetic polypeptide

SEQ ID NO: 957 - protein, 435 aa, Artificial Sequence; identical to SEQ ID NO: 923
  Description of Artificial Sequence: Synthetic polypeptide

SEQ ID NO: 958 - protein, 446 aa, Artificial Sequence; identical to SEQ ID NO: 893
  Description of Artificial Sequence: Synthetic polypeptide

SEQ ID NO: 959 - protein, 219 aa, Artificial Sequence; identical to SEQ ID NO: 894
  Description of Artificial Sequence: Synthetic polypeptide

SEQ ID NO: 960 - protein, 435 aa, Artificial Sequence; identical to SEQ ID NO: 923
  Description of Artificial Sequence: Synthetic polypeptide

SEQ ID NO: 961 - protein, 446 aa, Artificial Sequence; identical to SEQ ID NO: 896
  Description of Artificial Sequence: Synthetic polypeptide

SEQ ID NO: 962 - protein, 219 aa, Artificial Sequence; identical to SEQ ID NO: 183
  Description of Artificial Sequence: Synthetic polypeptide

SEQ ID NO: 963 - protein, 435 aa, Artificial Sequence; identical to SEQ ID NO: 923
  Description of Artificial Sequence: Synthetic polypeptide

SEQ ID NO: 964 - protein, 446 aa, Artificial Sequence; identical to SEQ ID NO: 899
  Description of Artificial Sequence: Synthetic polypeptide

SEQ ID NO: 965 - protein, 219 aa, Artificial Sequence; identical to SEQ ID NO: 183
  Description of Artificial Sequence: Synthetic polypeptide

SEQ ID NO: 966 - protein, 435 aa, Artificial Sequence; identical to SEQ ID NO: 923
  Description of Artificial Sequence: Synthetic polypeptide

SEQ ID NO: 967 - protein, 446 aa, Artificial Sequence; identical to SEQ ID NO: 899
  Description of Artificial Sequence: Synthetic polypeptide

SEQ ID NO: 968 - protein, 219 aa, Artificial Sequence; identical to SEQ ID NO: 903
  Description of Artificial Sequence: Synthetic polypeptide

SEQ ID NO: 969 - protein, 435 aa, Artificial Sequence; identical to SEQ ID NO: 923
  Description of Artificial Sequence: Synthetic polypeptide

SEQ ID NO: 970 - protein, 446 aa, Artificial Sequence; identical to SEQ ID NO: 905
  Description of Artificial Sequence: Synthetic polypeptide

SEQ ID NO: 971 - protein, 219 aa, Artificial Sequence; identical to SEQ ID NO: 828
  Description of Artificial Sequence: Synthetic polypeptide

SEQ ID NO: 972 - protein, 446 aa, Artificial Sequence; identical to SEQ ID NO: 370
  Description of Artificial Sequence: Synthetic polypeptide

SEQ ID NO: 973 - protein, 435 aa, Artificial Sequence; identical to SEQ ID NO: 371
  Description of Artificial Sequence: Synthetic polypeptide

SEQ ID NO: 974 - protein, 219 aa, Artificial Sequence; identical to SEQ ID NO: 183
  Description of Artificial Sequence: Synthetic polypeptide

SEQ ID NO: 975 - protein, 435 aa, Artificial Sequence; identical to SEQ ID NO: 371
  Description of Artificial Sequence: Synthetic polypeptide

SEQ ID NO: 976 - protein, 446 aa, Artificial Sequence
  Description of Artificial Sequence: Synthetic polypeptide
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 977 - protein, 219 aa, Artificial Sequence; identical to SEQ ID NO: 888
  Description of Artificial Sequence: Synthetic polypeptide

SEQ ID NO: 978 - protein, 435 aa, Artificial Sequence; identical to SEQ ID NO: 371
  Description of Artificial Sequence: Synthetic polypeptide

SEQ ID NO: 979 - protein, 446 aa, Artificial Sequence
  Description of Artificial Sequence: Synthetic polypeptide
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 980 - protein, 219 aa, Artificial Sequence; identical to SEQ ID NO: 828
  Description of Artificial Sequence: Synthetic polypeptide

SEQ ID NO: 981 - protein, 435 aa, Artificial Sequence; identical to SEQ ID NO: 371
  Description of Artificial Sequence: Synthetic polypeptide

SEQ ID NO: 982 - protein, 446 aa, Artificial Sequence
  Description of Artificial Sequence: Synthetic polypeptide
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 983 - protein, 219 aa, Artificial Sequence; identical to SEQ ID NO: 894
  Description of Artificial Sequence: Synthetic polypeptide

SEQ ID NO: 984 - protein, 435 aa, Artificial Sequence; identical to SEQ ID NO: 371
  Description of Artificial Sequence: Synthetic polypeptide

SEQ ID NO: 985 - protein, 446 aa, Artificial Sequence
  Description of Artificial Sequence: Synthetic polypeptide
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 986 - protein, 219 aa, Artificial Sequence; identical to SEQ ID NO: 183
  Description of Artificial Sequence: Synthetic polypeptide

SEQ ID NO: 987 - protein, 435 aa, Artificial Sequence; identical to SEQ ID NO: 371
  Description of Artificial Sequence: Synthetic polypeptide

SEQ ID NO: 988 - protein, 446 aa, Artificial Sequence
  Description of Artificial Sequence: Synthetic polypeptide
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 989 - protein, 219 aa, Artificial Sequence; identical to SEQ ID NO: 183
  Description of Artificial Sequence: Synthetic polypeptide

SEQ ID NO: 990 - protein, 435 aa, Artificial Sequence; identical to SEQ ID NO: 371
  Description of Artificial Sequence: Synthetic polypeptide

SEQ ID NO: 991 - protein, 446 aa, Artificial Sequence; identical to SEQ ID NO: 988
  Description of Artificial Sequence: Synthetic polypeptide

SEQ ID NO: 992 - protein, 219 aa, Artificial Sequence; identical to SEQ ID NO: 903
  Description of Artificial Sequence: Synthetic polypeptide

SEQ ID NO: 993 - protein, 435 aa, Artificial Sequence; identical to SEQ ID NO: 371
  Description of Artificial Sequence: Synthetic polypeptide

SEQ ID NO: 994 - protein, 446 aa, Artificial Sequence
  Description of Artificial Sequence: Synthetic polypeptide
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 995 - protein, 219 aa, Artificial Sequence; identical to SEQ ID NO: 828
  Description of Artificial Sequence: Synthetic polypeptide

SEQ ID NO: 996 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVEDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 997 - protein, 446 aa, Artificial Sequence; identical to SEQ ID NO: 370
  Description of Artificial Sequence: Synthetic polypeptide

SEQ ID NO: 998 - protein, 219 aa, Artificial Sequence; identical to SEQ ID NO: 183
  Description of Artificial Sequence: Synthetic polypeptide

SEQ ID NO: 999 - protein, 435 aa, Artificial Sequence; identical to SEQ ID NO: 996
  Description of Artificial Sequence: Synthetic polypeptide

SEQ ID NO: 1000 - protein, 446 aa, Artificial Sequence; identical to SEQ ID NO: 976
  Description of Artificial Sequence: Synthetic polypeptide

SEQ ID NO: 1001 - protein, 219 aa, Artificial Sequence; identical to SEQ ID NO: 888
  Description of Artificial Sequence: Synthetic polypeptide

SEQ ID NO: 1002 - protein, 435 aa, Artificial Sequence; identical to SEQ ID NO: 996
  Description of Artificial Sequence: Synthetic polypeptide

SEQ ID NO: 1003 - protein, 446 aa, Artificial Sequence; identical to SEQ ID NO: 979
  Description of Artificial Sequence: Synthetic polypeptide

SEQ ID NO: 1004 - protein, 219 aa, Artificial Sequence; identical to SEQ ID NO: 828
  Description of Artificial Sequence: Synthetic polypeptide

SEQ ID NO: 1005 - protein, 435 aa, Artificial Sequence; identical to SEQ ID NO: 996
  Description of Artificial Sequence: Synthetic polypeptide

SEQ ID NO: 1006 - protein, 446 aa, Artificial Sequence; identical to SEQ ID NO: 982
  Description of Artificial Sequence: Synthetic polypeptide

SEQ ID NO: 1007 - protein, 219 aa, Artificial Sequence; identical to SEQ ID NO: 894
  Description of Artificial Sequence: Synthetic polypeptide

SEQ ID NO: 1008 - protein, 435 aa, Artificial Sequence; identical to SEQ ID NO: 996
  Description of Artificial Sequence: Synthetic polypeptide

SEQ ID NO: 1009 - protein, 446 aa, Artificial Sequence; identical to SEQ ID NO: 985
  Description of Artificial Sequence: Synthetic polypeptide

SEQ ID NO: 1010 - protein, 219 aa, Artificial Sequence; identical to SEQ ID NO: 183
  Description of Artificial Sequence: Synthetic polypeptide

SEQ ID NO: 1011 - protein, 435 aa, Artificial Sequence; identical to SEQ ID NO: 996
  Description of Artificial Sequence: Synthetic polypeptide

SEQ ID NO: 1012 - protein, 446 aa, Artificial Sequence; identical to SEQ ID NO: 988
  Description of Artificial Sequence: Synthetic polypeptide

SEQ ID NO: 1013 - protein, 219 aa, Artificial Sequence; identical to SEQ ID NO: 183
  Description of Artificial Sequence: Synthetic polypeptide

SEQ ID NO: 1014 - protein, 435 aa, Artificial Sequence; identical to SEQ ID NO: 996
  Description of Artificial Sequence: Synthetic polypeptide

SEQ ID NO: 1015 - protein, 446 aa, Artificial Sequence; identical to SEQ ID NO: 988
  Description of Artificial Sequence: Synthetic polypeptide

SEQ ID NO: 1016 - protein, 219 aa, Artificial Sequence; identical to SEQ ID NO: 903
  Description of Artificial Sequence: Synthetic polypeptide

SEQ ID NO: 1017 - protein, 435 aa, Artificial Sequence; identical to SEQ ID NO: 996
  Description of Artificial Sequence: Synthetic polypeptide

SEQ ID NO: 1018 - protein, 446 aa, Artificial Sequence; identical to SEQ ID NO: 994
  Description of Artificial Sequence: Synthetic polypeptide

SEQ ID NO: 1019 - protein, 219 aa, Artificial Sequence; identical to SEQ ID NO: 828
  Description of Artificial Sequence: Synthetic polypeptide

SEQ ID NO: 1020 - protein, 435 aa, Artificial Sequence
  Description of Artificial Sequence: Synthetic polypeptide
ITCPPPMSVEHADIWVKSYSLYSRERYICNSGFKRKAGTSSLTECVLNKATNVAHWTTPSLKCIRGGGGSGGGGSGGGGSGGGGSGGGGSNWVNVISDLKKIEDLIQSMHIDATLYTESNVHPSCKVTAMKCFLLELQVISLESGDASIHDTVQDLIILANNSLSSNGNVTESGCKECEELEEKNIKEFLQSFVHIVQMFINTSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 1021 - protein, 446 aa, Artificial Sequence; identical to SEQ ID NO: 370
  Description of Artificial Sequence: Synthetic polypeptide

SEQ ID NO: 1022 - protein, 219 aa, Artificial Sequence; identical to SEQ ID NO: 183
  Description of Artificial Sequence: Synthetic polypeptide

SEQ ID NO: 1023 - protein, 435 aa, Artificial Sequence; identical to SEQ ID NO: 1020
  Description of Artificial Sequence: Synthetic polypeptide

SEQ ID NO: 1024 - protein, 446 aa, Artificial Sequence; identical to SEQ ID NO: 976
  Description of Artificial Sequence: Synthetic polypeptide

SEQ ID NO: 1025 - protein, 219 aa, Artificial Sequence; identical to SEQ ID NO: 888
  Description of Artificial Sequence: Synthetic polypeptide

SEQ ID NO: 1026 - protein, 435 aa, Artificial Sequence; identical to SEQ ID NO: 1020
  Description of Artificial Sequence: Synthetic polypeptide

SEQ ID NO: 1027 - protein, 446 aa, Artificial Sequence; identical to SEQ ID NO: 979
  Description of Artificial Sequence: Synthetic polypeptide

SEQ ID NO: 1028 - protein, 219 aa, Artificial Sequence; identical to SEQ ID NO: 828
  Description of Artificial Sequence: Synthetic polypeptide

SEQ ID NO: 1029 - protein, 435 aa, Artificial Sequence; identical to SEQ ID NO: 1020
  Description of Artificial Sequence: Synthetic polypeptide

SEQ ID NO: 1030 - protein, 446 aa, Artificial Sequence; identical to SEQ ID NO: 982
  Description of Artificial Sequence: Synthetic polypeptide

SEQ ID NO: 1031 - protein, 219 aa, Artificial Sequence; identical to SEQ ID NO: 894
  Description of Artificial Sequence: Synthetic polypeptide

SEQ ID NO: 1032 - protein, 435 aa, Artificial Sequence; identical to SEQ ID NO: 1020
  Description of Artificial Sequence: Synthetic polypeptide

SEQ ID NO: 1033 - protein, 446 aa, Artificial Sequence; identical to SEQ ID NO: 985
  Description of Artificial Sequence: Synthetic polypeptide

SEQ ID NO: 1034 - protein, 219 aa, Artificial Sequence; identical to SEQ ID NO: 183
  Description of Artificial Sequence: Synthetic polypeptide

SEQ ID NO: 1035 - protein, 435 aa, Artificial Sequence; identical to SEQ ID NO: 1020
  Description of Artificial Sequence: Synthetic polypeptide

SEQ ID NO: 1036 - protein, 435 aa, Artificial Sequence; identical to SEQ ID NO: 1020
  Description of Artificial Sequence: Synthetic polypeptide

SEQ ID NO: 1037 - protein, 446 aa, Artificial Sequence; identical to SEQ ID NO: 988
  Description of Artificial Sequence: Synthetic polypeptide

SEQ ID NO: 1038 - protein, 219 aa, Artificial Sequence; identical to SEQ ID NO: 903
  Description of Artificial Sequence: Synthetic polypeptide

SEQ ID NO: 1039 - protein, 435 aa, Artificial Sequence; identical to SEQ ID NO: 1020
  Description of Artificial Sequence: Synthetic polypeptide

SEQ ID NO: 1040 - protein, 446 aa, Artificial Sequence; identical to SEQ ID NO: 994
  Description of Artificial Sequence: Synthetic polypeptide

SEQ ID NO: 1041 - protein, 219 aa, Artificial Sequence; identical to SEQ ID NO: 828
  Description of Artificial Sequence: Synthetic polypeptide

SEQ ID NO: 1042 - protein, 435 aa, Artificial Sequence; identical to SEQ ID NO: 314
  Description of Artificial Sequence: Synthetic polypeptide

SEQ ID NO: 1043 - protein, 449 aa, Artificial Sequence
  Description of Artificial Sequence: Synthetic polypeptide
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1044 - protein, 213 aa, Artificial Sequence
  Description of Artificial Sequence: Synthetic polypeptide
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1045 - protein, 435 aa, Artificial Sequence; identical to SEQ ID NO: 921
  Description of Artificial Sequence: Synthetic polypeptide

SEQ ID NO: 1046 - protein, 449 aa, Artificial Sequence; identical to SEQ ID NO: 1043
  Description of Artificial Sequence: Synthetic polypeptide

SEQ ID NO: 1047 - protein, 213 aa, Artificial Sequence; identical to SEQ ID NO: 1044
  Description of Artificial Sequence: Synthetic polypeptide

SEQ ID NO: 1048 - protein, 435 aa, Artificial Sequence; identical to SEQ ID NO: 923
  Description of Artificial Sequence: Synthetic polypeptide

SEQ ID NO: 1049 - protein, 449 aa, Artificial Sequence; identical to SEQ ID NO: 1043
  Description of Artificial Sequence: Synthetic polypeptide

SEQ ID NO: 1050 - protein, 213 aa, Artificial Sequence; identical to SEQ ID NO: 1044
  Description of Artificial Sequence: Synthetic polypeptide

SEQ ID NO: 1051 - protein, 446 aa, Artificial Sequence; identical to SEQ ID NO: 988
  Description of Artificial Sequence: Synthetic polypeptide

SEQ ID NO: 1052 - protein, 219 aa, Artificial Sequence; identical to SEQ ID NO: 183
  Description of Artificial Sequence: Synthetic polypeptide

SEQ ID NO: 1053 - protein, 219 aa, Artificial Sequence; identical to SEQ ID NO: 183
  Description of Artificial Sequence: Synthetic polypeptide

SEQ ID NO: 1054 - protein, 219 aa, Artificial Sequence; identical to SEQ ID NO: 894
  Description of Artificial Sequence: Synthetic polypeptide

SEQ ID NO: 1055 - protein, 219 aa, Artificial Sequence
  Description of Artificial Sequence: Synthetic polypeptide
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1056 - protein, 219 aa, Artificial Sequence
  Description of Artificial Sequence: Synthetic polypeptide
DILMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1057 - protein, 219 aa, Artificial Sequence; identical to SEQ ID NO: 824
  Description of Artificial Sequence: Synthetic polypeptide

SEQ ID NO: 1058 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYSVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1059 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISRLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1060 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVATYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1061 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSVEAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1062 - protein, 219 aa, Artificial Sequence; identical to SEQ ID NO: 1056
  Description of Artificial Sequence: Synthetic polypeptide

SEQ ID NO: 1063 - protein, 219 aa, Artificial Sequence; identical to SEQ ID NO: 824
  Description of Artificial Sequence: Synthetic polypeptide

SEQ ID NO: 1064 - protein, 219 aa, Artificial Sequence; identical to SEQ ID NO: 1058
  Description of Artificial Sequence: Synthetic polypeptide

SEQ ID NO: 1065 - protein, 219 aa, Artificial Sequence; identical to SEQ ID NO: 1059
  Description of Artificial Sequence: Synthetic polypeptide

SEQ ID NO: 1066 - protein, 219 aa, Artificial Sequence; identical to SEQ ID NO: 1060
  Description of Artificial Sequence: Synthetic polypeptide

SEQ ID NO: 1067 - protein, 219 aa, Artificial Sequence; identical to SEQ ID NO: 1061
  Description of Artificial Sequence: Synthetic polypeptide

SEQ ID NO: 1068 - protein, 219 aa, Artificial Sequence; identical to SEQ ID NO: 1056
  Description of Artificial Sequence: Synthetic polypeptide

SEQ ID NO: 1069 - protein, 219 aa, Artificial Sequence; identical to SEQ ID NO: 824
  Description of Artificial Sequence: Synthetic polypeptide

SEQ ID NO: 1070 - protein, 219 aa, Artificial Sequence; identical to SEQ ID NO: 1058
  Description of Artificial Sequence: Synthetic polypeptide

SEQ ID NO: 1071 - protein, 219 aa, Artificial Sequence; identical to SEQ ID NO: 1059
  Description of Artificial Sequence: Synthetic polypeptide

SEQ ID NO: 1072 - protein, 219 aa, Artificial Sequence; identical to SEQ ID NO: 1060
  Description of Artificial Sequence: Synthetic polypeptide

SEQ ID NO: 1073 - protein, 219 aa, Artificial Sequence; identical to SEQ ID NO: 1061
  Description of Artificial Sequence: Synthetic polypeptide

SEQ ID NO: 1074 - protein, 219 aa, Artificial Sequence; identical to SEQ ID NO: 1056
  Description of Artificial Sequence: Synthetic polypeptide

SEQ ID NO: 1075 - protein, 219 aa, Artificial Sequence; identical to SEQ ID NO: 824
  Description of Artificial Sequence: Synthetic polypeptide

SEQ ID NO: 1076 - protein, 219 aa, Artificial Sequence; identical to SEQ ID NO: 1058
  Description of Artificial Sequence: Synthetic polypeptide

SEQ ID NO: 1077 - protein, 219 aa, Artificial Sequence; identical to SEQ ID NO: 1059
  Description of Artificial Sequence: Synthetic polypeptide

SEQ ID NO: 1078 - protein, 219 aa, Artificial Sequence; identical to SEQ ID NO: 1060
  Description of Artificial Sequence: Synthetic polypeptide

SEQ ID NO: 1079 - protein, 219 aa, Artificial Sequence; identical to SEQ ID NO: 1061
  Description of Artificial Sequence: Synthetic polypeptide

SEQ ID NO: 1080 - protein, 219 aa, Artificial Sequence; identical to SEQ ID NO: 183
  Description of Artificial Sequence: Synthetic polypeptide

SEQ ID NO: 1081 - protein, 219 aa, Artificial Sequence; identical to SEQ ID NO: 183
  Description of Artificial Sequence: Synthetic polypeptide

SEQ ID NO: 1082 - protein, 219 aa, Artificial Sequence; identical to SEQ ID NO: 183
  Description of Artificial Sequence: Synthetic polypeptide

SEQ ID NO: 1083 - protein, 219 aa, Artificial Sequence; identical to SEQ ID NO: 183
  Description of Artificial Sequence: Synthetic polypeptide

SEQ ID NO: 1084 - protein, 219 aa, Artificial Sequence; identical to SEQ ID NO: 183
  Description of Artificial Sequence: Synthetic polypeptide

SEQ ID NO: 1085 - protein, 219 aa, Artificial Sequence; identical to SEQ ID NO: 183
  Description of Artificial Sequence: Synthetic polypeptide

SEQ ID NO: 1086 - protein, 219 aa, Artificial Sequence; identical to SEQ ID NO: 183
  Description of Artificial Sequence: Synthetic polypeptide

SEQ ID NO: 1087 - protein, 219 aa, Artificial Sequence; identical to SEQ ID NO: 183
  Description of Artificial Sequence: Synthetic polypeptide

SEQ ID NO: 1088 - protein, 219 aa, Artificial Sequence; identical to SEQ ID NO: 825
  Description of Artificial Sequence: Synthetic polypeptide

SEQ ID NO: 1089 - protein, 219 aa, Artificial Sequence; identical to SEQ ID NO: 828
  Description of Artificial Sequence: Synthetic polypeptide

SEQ ID NO: 1090 - protein, 219 aa, Artificial Sequence; identical to SEQ ID NO: 836
  Description of Artificial Sequence: Synthetic polypeptide

SEQ ID NO: 1091 - protein, 219 aa, Artificial Sequence; identical to SEQ ID NO: 837
  Description of Artificial Sequence: Synthetic polypeptide

SEQ ID NO: 1092 - protein, 219 aa, Artificial Sequence; identical to SEQ ID NO: 842
  Description of Artificial Sequence: Synthetic polypeptide

SEQ ID NO: 1093 - protein, 219 aa, Artificial Sequence; identical to SEQ ID NO: 844
  Description of Artificial Sequence: Synthetic polypeptide

SEQ ID NO: 1094 - protein, 219 aa, Artificial Sequence; identical to SEQ ID NO: 856
  Description of Artificial Sequence: Synthetic polypeptide

SEQ ID NO: 1095 - protein, 219 aa, Artificial Sequence; identical to SEQ ID NO: 862
  Description of Artificial Sequence: Synthetic polypeptide

SEQ ID NO: 1096 - protein, 219 aa, Artificial Sequence; identical to SEQ ID NO: 867
  Description of Artificial Sequence: Synthetic polypeptide

SEQ ID NO: 1097 - protein, 219 aa, Artificial Sequence; identical to SEQ ID NO: 870
  Description of Artificial Sequence: Synthetic polypeptide

SEQ ID NO: 1098 - protein, 219 aa, Artificial Sequence; identical to SEQ ID NO: 878
  Description of Artificial Sequence: Synthetic polypeptide

SEQ ID NO: 1099 - protein, 219 aa, Artificial Sequence; identical to SEQ ID NO: 880
  Description of Artificial Sequence: Synthetic polypeptide

SEQ ID NO: 1100 - protein, 219 aa, Artificial Sequence; identical to SEQ ID NO: 883
  Description of Artificial Sequence: Synthetic polypeptide

SEQ ID NO: 1101 - protein, 219 aa, Artificial Sequence; identical to SEQ ID NO: 828
  Description of Artificial Sequence: Synthetic polypeptide

SEQ ID NO: 1102 - protein, 219 aa, Artificial Sequence; identical to SEQ ID NO: 828
  Description of Artificial Sequence: Synthetic polypeptide

SEQ ID NO: 1103 - protein, 219 aa, Artificial Sequence; identical to SEQ ID NO: 828
  Description of Artificial Sequence: Synthetic polypeptide

SEQ ID NO: 1104 - protein, 219 aa, Artificial Sequence; identical to SEQ ID NO: 856
  Description of Artificial Sequence: Synthetic polypeptide

SEQ ID NO: 1105 - protein, 219 aa, Artificial Sequence; identical to SEQ ID NO: 856
  Description of Artificial Sequence: Synthetic polypeptide

SEQ ID NO: 1106 - protein, 219 aa, Artificial Sequence; identical to SEQ ID NO: 856
  Description of Artificial Sequence: Synthetic polypeptide

SEQ ID NO: 1107 - protein, 219 aa, Artificial Sequence
  Description of Artificial Sequence: Synthetic polypeptide
DILMTQSPDSLAVSLGERATINCKSSQSIVHSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1108 - protein, 219 aa, Artificial Sequence; identical to SEQ ID NO: 183
  Description of Artificial Sequence: Synthetic polypeptide

SEQ ID NO: 1109 - protein, 219 aa, Artificial Sequence; identical to SEQ ID NO: 183
  Description of Artificial Sequence: Synthetic polypeptide

SEQ ID NO: 1110 - protein, 219 aa, Artificial Sequence; identical to SEQ ID NO: 183
  Description of Artificial Sequence: Synthetic polypeptide

SEQ ID NO: 1111 - protein, 219 aa, Artificial Sequence; identical to SEQ ID NO: 1107
  Description of Artificial Sequence: Synthetic polypeptide

SEQ ID NO: 1112 - protein, 219 aa, Artificial Sequence; identical to SEQ ID NO: 1107
  Description of Artificial Sequence: Synthetic polypeptide

SEQ ID NO: 1113 - protein, 219 aa, Artificial Sequence; identical to SEQ ID NO: 1056
  Description of Artificial Sequence: Synthetic polypeptide

SEQ ID NO: 1114 - protein, 219 aa, Artificial Sequence; identical to SEQ ID NO: 824
  Description of Artificial Sequence: Synthetic polypeptide

SEQ ID NO: 1115 - protein, 219 aa, Artificial Sequence; identical to SEQ ID NO: 1061
  Description of Artificial Sequence: Synthetic polypeptide

SEQ ID NO: 1116 - protein, 219 aa, Artificial Sequence; identical to SEQ ID NO: 824
  Description of Artificial Sequence: Synthetic polypeptide

SEQ ID NO: 1117 - protein, 219 aa, Artificial Sequence; identical to SEQ ID NO: 1107
  Description of Artificial Sequence: Synthetic polypeptide

SEQ ID NO: 1118 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPELLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1119 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPQLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1120 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPTLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1121 - protein, 219 aa, Artificial Sequence
  Description of Artificial Sequence: Synthetic polypeptide
DVLMTQSPDSLAVSLGERATINCKSSQSIVISNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1122 - protein, 219 aa, Artificial Sequence
  Description of Artificial Sequence: Synthetic polypeptide
DVLMTQSPDSLAVSLGERATINCKSSQSIVLSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1123 - protein, 219 aa, Artificial Sequence
  Description of Artificial Sequence: Synthetic polypeptide
DVLMTQSPDSLAVSLGERATINCKSSQSIVVSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1124 - protein, 219 aa, Artificial Sequence
  Description of Artificial Sequence: Synthetic polypeptide
DVLMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1125 - protein, 219 aa, Artificial Sequence
  Description of Artificial Sequence: Synthetic polypeptide
DVLMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1126 - protein, 219 aa, Artificial Sequence
  Description of Artificial Sequence: Synthetic polypeptide
DILMTQSPDSLAVSLGERATINCKSSQSIVFSNGNNYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1127 - protein, 219 aa, Artificial Sequence; identical to SEQ ID NO: 888
  Description of Artificial Sequence: Synthetic polypeptide

SEQ ID NO: 1128 - protein, 219 aa, Artificial Sequence; identical to SEQ ID NO: 183
  Description of Artificial Sequence: Synthetic polypeptide

SEQ ID NO: 1129 - protein, 219 aa, Artificial Sequence; identical to SEQ ID NO: 183
  Description of Artificial Sequence: Synthetic polypeptide

SEQ ID NO: 1130 - protein, 219 aa, Artificial Sequence; identical to SEQ ID NO: 183
  Description of Artificial Sequence: Synthetic polypeptide

SEQ ID NO: 1131 - protein, 219 aa, Artificial Sequence; identical to SEQ ID NO: 183
  Description of Artificial Sequence: Synthetic polypeptide

SEQ ID NO: 1132 - protein, 219 aa, Artificial Sequence; identical to SEQ ID NO: 183
  Description of Artificial Sequence: Synthetic polypeptide

SEQ ID NO: 1133 - protein, 219 aa, Artificial Sequence; identical to SEQ ID NO: 183
  Description of Artificial Sequence: Synthetic polypeptide

SEQ ID NO: 1134 - protein, 219 aa, Artificial Sequence; identical to SEQ ID NO: 183
  Description of Artificial Sequence: Synthetic polypeptide

SEQ ID NO: 1135 - protein, 219 aa, Artificial Sequence; identical to SEQ ID NO: 183
  Description of Artificial Sequence: Synthetic polypeptide

SEQ ID NO: 1136 - protein, 219 aa, Artificial Sequence; identical to SEQ ID NO: 183
  Description of Artificial Sequence: Synthetic polypeptide

SEQ ID NO: 1137 - protein, 219 aa, Artificial Sequence; identical to SEQ ID NO: 183
  Description of Artificial Sequence: Synthetic polypeptide

SEQ ID NO: 1138 - protein, 219 aa, Artificial Sequence; identical to SEQ ID NO: 183
  Description of Artificial Sequence: Synthetic polypeptide

SEQ ID NO: 1139 - protein, 219 aa, Artificial Sequence; identical to SEQ ID NO: 183
  Description of Artificial Sequence: Synthetic polypeptide

SEQ ID NO: 1140 - protein, 219 aa, Artificial Sequence; identical to SEQ ID NO: 183
  Description of Artificial Sequence: Synthetic polypeptide

SEQ ID NO: 1141 - protein, 219 aa, Artificial Sequence; identical to SEQ ID NO: 183
  Description of Artificial Sequence: Synthetic polypeptide

SEQ ID NO: 1142 - protein, 219 aa, Artificial Sequence; identical to SEQ ID NO: 183
  Description of Artificial Sequence: Synthetic polypeptide

SEQ ID NO: 1143 - protein, 219 aa, Artificial Sequence; identical to SEQ ID NO: 183
  Description of Artificial Sequence: Synthetic polypeptide

SEQ ID NO: 1144 - protein, 219 aa, Artificial Sequence; identical to SEQ ID NO: 183
  Description of Artificial Sequence: Synthetic polypeptide

SEQ ID NO: 1145 - protein, 219 aa, Artificial Sequence; identical to SEQ ID NO: 183
  Description of Artificial Sequence: Synthetic polypeptide

SEQ ID NO: 1146 - protein, 219 aa, Artificial Sequence; identical to SEQ ID NO: 828
  Description of Artificial Sequence: Synthetic polypeptide

SEQ ID NO: 1147 - protein, 219 aa, Artificial Sequence; identical to SEQ ID NO: 828
  Description of Artificial Sequence: Synthetic polypeptide

SEQ ID NO: 1148 - protein, 219 aa, Artificial Sequence; identical to SEQ ID NO: 828
  Description of Artificial Sequence: Synthetic polypeptide

SEQ ID NO: 1149 - protein, 219 aa, Artificial Sequence; identical to SEQ ID NO: 828
  Description of Artificial Sequence: Synthetic polypeptide

SEQ ID NO: 1150 - protein, 219 aa, Artificial Sequence; identical to SEQ ID NO: 828
  Description of Artificial Sequence: Synthetic polypeptide

SEQ ID NO: 1151 - protein, 219 aa, Artificial Sequence; identical to SEQ ID NO: 828
  Description of Artificial Sequence: Synthetic polypeptide

SEQ ID NO: 1152 - protein, 219 aa, Artificial Sequence; identical to SEQ ID NO: 828
  Description of Artificial Sequence: Synthetic polypeptide

SEQ ID NO: 1153 - protein, 219 aa, Artificial Sequence; identical to SEQ ID NO: 828
  Description of Artificial Sequence: Synthetic polypeptide

SEQ ID NO: 1154 - protein, 219 aa, Artificial Sequence; identical to SEQ ID NO: 888
  Description of Artificial Sequence: Synthetic polypeptide

SEQ ID NO: 1155 - protein, 219 aa, Artificial Sequence; identical to SEQ ID NO: 888
  Description of Artificial Sequence: Synthetic polypeptide

SEQ ID NO: 1156 - protein, 219 aa, Artificial Sequence; identical to SEQ ID NO: 888
  Description of Artificial Sequence: Synthetic polypeptide

SEQ ID NO: 1157 - protein, 219 aa, Artificial Sequence; identical to SEQ ID NO: 888
  Description of Artificial Sequence: Synthetic polypeptide

SEQ ID NO: 1158 - protein, 219 aa, Artificial Sequence; identical to SEQ ID NO: 888
  Description of Artificial Sequence: Synthetic polypeptide

SEQ ID NO: 1159 - protein, 219 aa, Artificial Sequence; identical to SEQ ID NO: 888
  Description of Artificial Sequence: Synthetic polypeptide

SEQ ID NO: 1160 - protein, 219 aa, Artificial Sequence; identical to SEQ ID NO: 888
  Description of Artificial Sequence: Synthetic polypeptide

SEQ ID NO: 1161 - protein, 219 aa, Artificial Sequence; identical to SEQ ID NO: 888
  Description of Artificial Sequence: Synthetic polypeptide

SEQ ID NO: 1162 - protein, 219 aa, Artificial Sequence; identical to SEQ ID NO: 1126
  Description of Artificial Sequence: Synthetic polypeptide

SEQ ID NO: 1163 - protein, 219 aa, Artificial Sequence; identical to SEQ ID NO: 888
  Description of Artificial Sequence: Synthetic polypeptide

SEQ ID NO: 1164 - protein, 219 aa, Artificial Sequence; identical to SEQ ID NO: 1126
  Description of Artificial Sequence: Synthetic polypeptide

SEQ ID NO: 1165 - protein, 219 aa, Artificial Sequence; identical to SEQ ID NO: 1126
  Description of Artificial Sequence: Synthetic polypeptide

SEQ ID NO: 1166 - protein, 219 aa, Artificial Sequence; identical to SEQ ID NO: 1126
  Description of Artificial Sequence: Synthetic polypeptide

SEQ ID NO: 1167 - protein, 219 aa, Artificial Sequence; identical to SEQ ID NO: 888
  Description of Artificial Sequence: Synthetic polypeptide

SEQ ID NO: 1168 - protein, 219 aa, Artificial Sequence; identical to SEQ ID NO: 888
  Description of Artificial Sequence: Synthetic polypeptide

SEQ ID NO: 1169 - protein, 219 aa, Artificial Sequence; identical to SEQ ID NO: 888
  Description of Artificial Sequence: Synthetic polypeptide

SEQ ID NO: 1170 - protein, 219 aa, Artificial Sequence; identical to SEQ ID NO: 888
  Description of Artificial Sequence: Synthetic polypeptide

SEQ ID NO: 1171 - protein, 219 aa, Artificial Sequence; identical to SEQ ID NO: 888
  Description of Artificial Sequence: Synthetic polypeptide

SEQ ID NO: 1172 - protein, 219 aa, Artificial Sequence; identical to SEQ ID NO: 888
  Description of Artificial Sequence: Synthetic polypeptide

SEQ ID NO: 1173 - protein, 219 aa, Artificial Sequence; identical to SEQ ID NO: 888
  Description of Artificial Sequence: Synthetic polypeptide

SEQ ID NO: 1174 - protein, 219 aa, Artificial Sequence; identical to SEQ ID NO: 888
  Description of Artificial Sequence: Synthetic polypeptide

SEQ ID NO: 1175 - protein, 219 aa, Artificial Sequence; identical to SEQ ID NO: 888
  Description of Artificial Sequence: Synthetic polypeptide

SEQ ID NO: 1176 - protein, 219 aa, Artificial Sequence; identical to SEQ ID NO: 888
  Description of Artificial Sequence: Synthetic polypeptide

SEQ ID NO: 1177 - protein, 219 aa, Artificial Sequence; identical to SEQ ID NO: 888
  Description of Artificial Sequence: Synthetic polypeptide

SEQ ID NO: 1178 - protein, 219 aa, Artificial Sequence; identical to SEQ ID NO: 888
  Description of Artificial Sequence: Synthetic polypeptide

SEQ ID NO: 1179 - protein, 219 aa, Artificial Sequence; identical to SEQ ID NO: 828
  Description of Artificial Sequence: Synthetic polypeptide

SEQ ID NO: 1180 - protein, 219 aa, Artificial Sequence; identical to SEQ ID NO: 828
  Description of Artificial Sequence: Synthetic polypeptide

SEQ ID NO: 1181 - protein, 219 aa, Artificial Sequence; identical to SEQ ID NO: 828
  Description of Artificial Sequence: Synthetic polypeptide

SEQ ID NO: 1182 - protein, 219 aa, Artificial Sequence; identical to SEQ ID NO: 183
  Description of Artificial Sequence: Synthetic polypeptide

SEQ ID NO: 1183 - protein, 219 aa, Artificial Sequence; identical to SEQ ID NO: 183
  Description of Artificial Sequence: Synthetic polypeptide

SEQ ID NO: 1184 - protein, 219 aa, Artificial Sequence; identical to SEQ ID NO: 183
  Description of Artificial Sequence: Synthetic polypeptide

SEQ ID NO: 1185 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDIAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1186 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCQQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1187 - protein, 219 aa, Artificial Sequence
  Description of Artificial Sequence: Synthetic polypeptide
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQYSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1188 - protein, 219 aa, Artificial Sequence; identical to SEQ ID NO: 183
  Description of Artificial Sequence: Synthetic polypeptide

SEQ ID NO: 1189 - protein, 219 aa, Artificial Sequence; identical to SEQ ID NO: 183
  Description of Artificial Sequence: Synthetic polypeptide

SEQ ID NO: 1190 - protein, 219 aa, Artificial Sequence; identical to SEQ ID NO: 183
  Description of Artificial Sequence: Synthetic polypeptide

SEQ ID NO: 1191 - protein, 219 aa, Artificial Sequence; identical to SEQ ID NO: 183
  Description of Artificial Sequence: Synthetic polypeptide

SEQ ID NO: 1192 - protein, 219 aa, Artificial Sequence; identical to SEQ ID NO: 183
  Description of Artificial Sequence: Synthetic polypeptide

SEQ ID NO: 1193 - protein, 219 aa, Artificial Sequence; identical to SEQ ID NO: 183
  Description of Artificial Sequence: Synthetic polypeptide

SEQ ID NO: 1194 - protein, 219 aa, Artificial Sequence; identical to SEQ ID NO: 183
  Description of Artificial Sequence: Synthetic polypeptide

SEQ ID NO: 1195 - protein, 219 aa, Artificial Sequence; identical to SEQ ID NO: 183
  Description of Artificial Sequence: Synthetic polypeptide

SEQ ID NO: 1196 - protein, 219 aa, Artificial Sequence; identical to SEQ ID NO: 183
  Description of Artificial Sequence: Synthetic polypeptide

SEQ ID NO: 1197 - protein, 219 aa, Artificial Sequence; identical to SEQ ID NO: 183
  Description of Artificial Sequence: Synthetic polypeptide

SEQ ID NO: 1198 - protein, 219 aa, Artificial Sequence; identical to SEQ ID NO: 183
  Description of Artificial Sequence: Synthetic polypeptide

SEQ ID NO: 1199 - protein, 219 aa, Artificial Sequence; identical to SEQ ID NO: 183
  Description of Artificial Sequence: Synthetic polypeptide

SEQ ID NO: 1200 - protein, 219 aa, Artificial Sequence; identical to SEQ ID NO: 183
  Description of Artificial Sequence: Synthetic polypeptide

SEQ ID NO: 1201 - protein, 219 aa, Artificial Sequence; identical to SEQ ID NO: 183
  Description of Artificial Sequence: Synthetic polypeptide

SEQ ID NO: 1202 - protein, 219 aa, Artificial Sequence; identical to SEQ ID NO: 183
  Description of Artificial Sequence: Synthetic polypeptide

SEQ ID NO: 1203 - protein, 219 aa, Artificial Sequence; identical to SEQ ID NO: 183
  Description of Artificial Sequence: Synthetic polypeptide

SEQ ID NO: 1204 - protein, 219 aa, Artificial Sequence; identical to SEQ ID NO: 183
  Description of Artificial Sequence: Synthetic polypeptide

SEQ ID NO: 1205 - protein, 219 aa, Artificial Sequence; identical to SEQ ID NO: 831
  Description of Artificial Sequence: Synthetic polypeptide

SEQ ID NO: 1206 - protein, 219 aa, Artificial Sequence; identical to SEQ ID NO: 833
  Description of Artificial Sequence: Synthetic polypeptide

SEQ ID NO: 1207 - protein, 219 aa, Artificial Sequence; identical to SEQ ID NO: 839
  Description of Artificial Sequence: Synthetic polypeptide

SEQ ID NO: 1208 - protein, 219 aa, Artificial Sequence; identical to SEQ ID NO: 849
  Description of Artificial Sequence: Synthetic polypeptide

SEQ ID NO: 1209 - protein, 219 aa, Artificial Sequence; identical to SEQ ID NO: 857
  Description of Artificial Sequence: Synthetic polypeptide

SEQ ID NO: 1210 - protein, 219 aa, Artificial Sequence; identical to SEQ ID NO: 858
  Description of Artificial Sequence: Synthetic polypeptide

SEQ ID NO: 1211 - protein, 219 aa, Artificial Sequence; identical to SEQ ID NO: 865
  Description of Artificial Sequence: Synthetic polypeptide

SEQ ID NO: 1212 - protein, 219 aa, Artificial Sequence; identical to SEQ ID NO: 868
  Description of Artificial Sequence: Synthetic polypeptide

SEQ ID NO: 1213 - protein, 219 aa, Artificial Sequence; identical to SEQ ID NO: 869
  Description of Artificial Sequence: Synthetic polypeptide

SEQ ID NO: 1214 - protein, 219 aa, Artificial Sequence; identical to SEQ ID NO: 872
  Description of Artificial Sequence: Synthetic polypeptide

SEQ ID NO: 1215 - protein, 219 aa, Artificial Sequence; identical to SEQ ID NO: 874
  Description of Artificial Sequence: Synthetic polypeptide

SEQ ID NO: 1216 - protein, 219 aa, Artificial Sequence; identical to SEQ ID NO: 183
  Description of Artificial Sequence: Synthetic polypeptide

SEQ ID NO: 1217 - protein, 5 aa, Artificial Sequence
  Description of Artificial Sequence: Synthetic peptide
GSGGS

SEQ ID NO: 1218 - protein, 5 aa, Artificial Sequence
  Description of Artificial Sequence: Synthetic peptide
GGGGS

SEQ ID NO: 1219 - protein, 4 aa, Artificial Sequence
  Description of Artificial Sequence: Synthetic peptide
GGGS

SEQ ID NO: 1220 - protein, 4 aa, Artificial Sequence
  Description of Artificial Sequence: Synthetic peptide
EPKS

SEQ ID NO: 1221 - protein, 6 aa, Artificial Sequence
  Description of Artificial Sequence: Synthetic 6xHis tag
HHHHHH

What is claimed is:

1. A PD-1 targeted IL-15/Rα heterodimeric Fc fusion protein comprising:
   a) a first monomer comprising, from N- to C-terminal:
      i) an IL-15 receptor alpha (IL-15Rα) sushi domain;
      ii) a first domain linker,
      iii) a variant IL-15 domain, and
      iv) a second domain linker, and
      v) a first variant human IgG1 Fc domain comprising CH2-CH3; and
   b) a second monomer comprising, from N- to C-terminal:
      a heavy chain comprising VH-CH1-hinge-CH2-CH3, wherein said CH2-CH3 is a second human IgG1 variant Fc domain; and
   c) a light chain comprising VL-CL;
   wherein said VH and VL form an antigen binding domain that binds human PD-1 and have sequences selected from the pairs consisting of 1C11[PD-1]_H3L3 from XENP22553(SEQ ID NOS:186-187), 1C11[PD-1]_H3.234 L3.144 from XENP25806 (SEQ ID NOS:578-579), 1C11[PD-1]_H3.240 L3.148 from XENP25812 (SEQ ID NO:584), 1C11[PD-1]_H3.241 L3.148 from XENP25813 (SEQ ID NO:585), 1C11[PD-1]_H3.241 L3.92 from XENP25819 (SEQ ID NO:591), 1C11[PD-1]_H3.303 L3.152 from XENP26940 (SEQ ID NOS: 642 and 1103), 1C11[PD-1]_H3.329 L3.220 from XENP28026 (SEQ ID NOS:708 and 1169), and 1C11[PD-1]_H3.328 L3.152 from XENP28652 (SEQ ID NOS:719 and 1180); and
   wherein said first variant and said second variant human IgG1 Fc domains have a set of amino acid substitutions selected from the group consisting of S267K/L368D/K370S: S267K/LS364K/E357Q; S364K/E357Q: L368D/K370S; L368D/K370S: S364K; L368E/K370S: S364K; T411E/K360E/Q362E: D401K; L368D/K370S: S364K/E357L; L368D/K370S: S364K/E357Q; and K370S: S364K/E357Q, respectively and according to EU numbering.

2. The heterodimeric Fc fusion protein according to claim 1, wherein said first variant Fc domain and/or said second variant Fc domain have amino acid substitutions comprising Q295E/N384D/Q418E/N421D, according to EU numbering.

3. The heterodimeric Fc fusion protein according to claim 1, wherein said first variant and said variant second human IgG1 Fc domains each have amino acid substitutions selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to EU numbering.

4. The heterodimeric Fc fusion protein according to claim 1, wherein said first variant and said second variant Fc domains each have amino acid substitution M428L/N434S, according to EU numbering.

5. The heterodimeric Fc fusion protein according to claim 1, wherein said variant IL-15 domain comprises the amino acid sequence of SEQ ID NO:2.

6. The heterodimeric Fc fusion protein according to claim 1 wherein said variant IL-15 domain comprises the amino acid sequence of SEQ ID NO:2 and amino acid substitutions selected from the group consisting of N4D/N65D, D30N/N65D, and D30N/E64Q/N65D.

7. The heterodimeric Fc fusion protein according to claim 1, wherein said IL-15Rα sushi domain comprises the amino acid sequence of SEQ ID NO:4.

8. The heterodimeric Fc fusion protein according to claim 1, wherein the first monomer, the second monomer and the light chain are selected from the group consisting of:
- a first monomer comprising SEQ ID NO:925, a second monomer comprising SEQ ID NO:926, and a light chain comprising SEQ ID NO:1216;
- a first monomer comprising SEQ ID NO:927, a second monomer comprising SEQ ID NO:928, and a light chain comprising SEQ ID NO:929;
- a first monomer comprising SEQ ID NO:930, a second monomer comprising SEQ ID NO:931, and a light chain comprising SEQ ID NO:932;
- a first monomer comprising SEQ ID NO:933, a second monomer comprising SEQ ID NO:934, and a light chain comprising SEQ ID NO:935;
- a first monomer comprising SEQ ID NO:936, a second monomer comprising SEQ ID NO:937, and a light chain comprising SEQ ID NO:938;
- a first monomer comprising SEQ ID NO:939, a second monomer comprising SEQ ID NO:940, and a light chain comprising SEQ ID NO:941;
- a first monomer comprising SEQ ID NO:942, a second monomer comprising SEQ ID NO:943, and a light chain comprising SEQ ID NO:944;
- a first monomer comprising SEQ ID NO:945, a second monomer comprising SEQ ID NO:946, and a light chain comprising SEQ ID NO:947;
- a first monomer comprising SEQ ID NO:948, a second monomer comprising SEQ ID NO:949, and a light chain comprising SEQ ID NO:950;
- a first monomer comprising SEQ ID NO:951, a second monomer comprising SEQ ID NO:952, and a light chain comprising SEQ ID NO:953;
- a first monomer comprising SEQ ID NO:954, a second monomer comprising SEQ ID NO:955, and a light chain comprising SEQ ID NO:956;
- a first monomer comprising SEQ ID NO:957, a second monomer comprising SEQ ID NO:958, and a light chain comprising SEQ ID NO:959;
- a first monomer comprising SEQ ID NO:960, a second monomer comprising SEQ ID NO:961, and a light chain comprising SEQ ID NO:962,
- a first monomer comprising SEQ ID NO:963, a second monomer comprising SEQ ID NO:964, and a light chain comprising SEQ ID NO:965,
- a first monomer comprising SEQ ID NO:966, a second monomer comprising SEQ ID NO:967, and a light chain comprising SEQ ID NO:968,
- a first monomer comprising SEQ ID NO:969, a second monomer comprising SEQ ID NO:970, and a light chain comprising SEQ ID NO:971,
- a first monomer comprising SEQ ID NO:972, a second monomer comprising SEQ ID NO:973, and a light chain comprising SEQ ID NO:974,
- a first monomer comprising SEQ ID NO:975, a second monomer comprising SEQ ID NO:976, and a light chain comprising SEQ ID NO:977,
- a first monomer comprising SEQ ID NO:978, a second monomer comprising SEQ ID NO:979, and a light chain comprising SEQ ID NO:980,
- a first monomer comprising SEQ ID NO:981, a second monomer comprising SEQ ID NO:982, and a light chain comprising SEQ ID NO:983,
- a first monomer comprising SEQ ID NO:984, a second monomer comprising SEQ ID NO:985, and a light chain comprising SEQ ID NO:986,
- a first monomer comprising SEQ ID NO:987, a second monomer comprising SEQ ID NO:988, and a light chain comprising SEQ ID NO:989,
- a first monomer comprising SEQ ID NO:990, a second monomer comprising SEQ ID NO:991, and a light chain comprising SEQ ID NO:992,
- a first monomer comprising SEQ ID NO:993, a second monomer comprising SEQ ID NO:994, and a light chain comprising SEQ ID NO:995,
- a first monomer comprising SEQ ID NO:996, a second monomer comprising SEQ ID NO:997, and a light chain comprising SEQ ID NO:998,
- a first monomer comprising SEQ ID NO:999, a second monomer comprising SEQ ID NO:1000, and a light chain comprising SEQ ID NO:1001;
- a first monomer comprising SEQ ID NO:1002, a second monomer comprising SEQ ID NO:1003, and a light chain comprising SEQ ID NO:1004;
- a first monomer comprising SEQ ID NO:1005, a second monomer comprising SEQ ID NO:1006, and a light chain comprising SEQ ID NO:1007;
- a first monomer comprising SEQ ID NO:1008, a second monomer comprising SEQ ID NO:1009, and a light chain comprising SEQ ID NO:1010;
- a first monomer comprising SEQ ID NO:1011, a second monomer comprising SEQ ID NO:1012, and a light chain comprising SEQ ID NO:1013;
- a first monomer comprising SEQ ID NO:1014, a second monomer comprising SEQ ID NO:1015, and a light chain comprising SEQ ID NO:1016;
- a first monomer comprising SEQ ID NO:1017, a second monomer comprising SEQ ID NO:1018, and a light chain comprising SEQ ID NO:1019;
- a first monomer comprising SEQ ID NO:1020, a second monomer comprising SEQ ID NO:1021, and a light chain comprising SEQ ID NO:1022;
- a first monomer comprising SEQ ID NO:1023, a second monomer comprising SEQ ID NO:1024, and a light chain comprising SEQ ID NO:1025;
- a first monomer comprising SEQ ID NO:1026, a second monomer comprising SEQ ID NO:1027, and a light chain comprising SEQ ID NO:1028;
- a first monomer comprising SEQ ID NO:1029, a second monomer comprising SEQ ID NO:1030, and a light chain comprising SEQ ID NO:1031;
- a first monomer comprising SEQ ID NO:1032, a second monomer comprising SEQ ID NO:1033, and a light chain comprising SEQ ID NO:1034;
- a first monomer comprising SEQ ID NO:1035, a second monomer comprising SEQ ID NO:1051, and a light chain comprising SEQ ID NO:1052;

a first monomer comprising SEQ ID NO:1036, a second monomer comprising SEQ ID NO:1037, and a light chain comprising SEQ ID NO:1038; and a first monomer comprising SEQ ID NO:1039, a second monomer comprising SEQ ID NO:1040, and a light chain comprising SEQ ID NO:1041.

9. A nucleic acid composition comprising:
a) a first nucleic acid encoding the first monomer of the heterodimeric Fc fusion protein according to claim 1;
b) a second nucleic acid encoding the second monomer of the heterodimeric Fc fusion protein according to claim 1; and
c) a third nucleic acid encoding the light chain of the heterodimeric Fc fusion protein according to claim 1, respectively.

10. An expression vector composition comprising:
a) a first expression vector comprising said first nucleic acid of claim 9;
b) a second expression vector comprising said second nucleic acid of claim 9; and
c) a third expression vector comprising said third nucleic acid of claim 9.

11. A host cell comprising the nucleic acid composition of claim 9 or the expression vector composition of claim 10.

12. A method of producing a PD-1 targeted IL-15/Rα heterodimeric Fc fusion protein comprising: culturing the host cell of claim 11 under suitable conditions, wherein said heterodimeric Fc fusion protein is expressed; and recovering said protein.

13. A method of treating cancer in a patient in need thereof comprising administering a therapeutically effective amount of a PD-1 targeted IL-15/Rα heterodimeric Fc fusion protein according to claim 1 to said patient.

14. The method of claim 13, further comprising administering a therapeutically effective amount of a checkpoint blockade antibody.

15. The method according to claim 14, wherein said checkpoint blockade antibody is selected from the group consisting of an anti-PD-1 antibody, an anti-PD-L1 antibody, an anti-TIM3 antibody, an anti-TIGIT antibody, an anti-LAG3 antibody, and an anti-CTLA-4 antibody.

16. The method according to claim 15, wherein said anti-PD-L1 antibody is atezolizumab, avelumab, or durbalumab.

17. A PD-1 targeted IL-15/Rα heterodimeric Fc fusion protein comprising a first monomer, a second monomer and a light chain, wherein the first monomer, the second monomer and the light chain are selected from the group consisting of:

a first monomer comprising SEQ ID NO:925, a second monomer comprising SEQ ID NO:926, and a light chain comprising SEQ ID NO:1216;

a first monomer comprising SEQ ID NO:927, a second monomer comprising SEQ ID NO:928, and a light chain comprising SEQ ID NO:929;

a first monomer comprising SEQ ID NO:930, a second monomer comprising SEQ ID NO:931, and a light chain comprising SEQ ID NO:932;

a first monomer comprising SEQ ID NO:933, a second monomer comprising SEQ ID NO:934, and a light chain comprising SEQ ID NO:935;

a first monomer comprising SEQ ID NO:936, a second monomer comprising SEQ ID NO:937, and a light chain comprising SEQ ID NO:938;

a first monomer comprising SEQ ID NO:939, a second monomer comprising SEQ ID NO:940, and a light chain comprising SEQ ID NO:941;

a first monomer comprising SEQ ID NO:942, a second monomer comprising SEQ ID NO:943, and a light chain comprising SEQ ID NO:944;

a first monomer comprising SEQ ID NO:945, a second monomer comprising SEQ ID NO:946, and a light chain comprising SEQ ID NO:947;

a first monomer comprising SEQ ID NO:948, a second monomer comprising SEQ ID NO:949, and a light chain comprising SEQ ID NO:950;

a first monomer comprising SEQ ID NO:951, a second monomer comprising SEQ ID NO:952, and a light chain comprising SEQ ID NO:953;

a first monomer comprising SEQ ID NO:954, a second monomer comprising SEQ ID NO:955, and a light chain comprising SEQ ID NO:956, a first monomer comprising SEQ ID NO:957, a second monomer comprising SEQ ID NO:958, and a light chain comprising SEQ ID NO:959, a first monomer comprising SEQ ID NO:960, a second monomer comprising SEQ ID NO:961, and a light chain comprising SEQ ID NO:962, a first monomer comprising SEQ ID NO:963, a second monomer comprising SEQ ID NO:964, and a light chain comprising SEQ ID NO:965, a first monomer comprising SEQ ID NO:966, a second monomer comprising SEQ ID NO:967, and a light chain comprising SEQ ID NO:968, a first monomer comprising SEQ ID NO:969, a second monomer comprising SEQ ID NO:970, and a light chain comprising SEQ ID NO:971, a first monomer comprising SEQ ID NO:972, a second monomer comprising SEQ ID NO:973, and a light chain comprising SEQ ID NO:974, a first monomer comprising SEQ ID NO:975, a second monomer comprising SEQ ID NO:976, and a light chain comprising SEQ ID NO:977, a first monomer comprising SEQ ID NO:978, a second monomer comprising SEQ ID NO:979, and a light chain comprising SEQ ID NO:980, a first monomer comprising SEQ ID NO:981, a second monomer comprising SEQ ID NO:982, and a light chain comprising SEQ ID NO:983, a first monomer comprising SEQ ID NO:984, a second monomer comprising SEQ ID NO:985, and a light chain comprising SEQ ID NO:986, a first monomer comprising SEQ ID NO:987, a second monomer comprising SEQ ID NO:988, and a light chain comprising SEQ ID NO:989, a first monomer comprising SEQ ID NO:990, a second monomer comprising SEQ ID NO:991, and a light chain comprising SEQ ID NO:992, a first monomer comprising SEQ ID NO:993, a second monomer comprising SEQ ID NO:994, and a light chain comprising SEQ ID NO:995;

a first monomer comprising SEQ ID NO:996, a second monomer comprising SEQ ID NO:997, and a light chain comprising SEQ ID NO:998;

a first monomer comprising SEQ ID NO:999, a second monomer comprising SEQ ID NO:1000, and a light chain comprising SEQ ID NO:1001;

a first monomer comprising SEQ ID NO:1002, a second monomer comprising SEQ ID NO:1003, and a light chain comprising SEQ ID NO:1004;

a first monomer comprising SEQ ID NO:1005, a second monomer comprising SEQ ID NO:1006, and a light chain comprising SEQ ID NO:1007;

a first monomer comprising SEQ ID NO:1008, a second monomer comprising SEQ ID NO:1009, and a light chain comprising SEQ ID NO:1010;

a first monomer comprising SEQ ID NO:1011, a second monomer comprising SEQ ID NO:1012, and a light chain comprising SEQ ID NO:1013;

a first monomer comprising SEQ ID NO:1014, a second monomer comprising SEQ ID NO:1015, and a light chain comprising SEQ ID NO:1016;

a first monomer comprising SEQ ID NO:1017, a second monomer comprising SEQ ID NO:1018, and a light chain comprising SEQ ID NO:1019;

a first monomer comprising SEQ ID NO:1020, a second monomer comprising SEQ ID NO:1021, and a light chain comprising SEQ ID NO:1022;

a first monomer comprising SEQ ID NO:1023, a second monomer comprising SEQ ID NO:1024, and a light chain comprising SEQ ID NO:1025;

a first monomer comprising SEQ ID NO:1026, a second monomer comprising SEQ ID NO:1027, and a light chain comprising SEQ ID NO:1028;

a first monomer comprising SEQ ID NO:1029, a second monomer comprising SEQ ID NO:1030, and a light chain comprising SEQ ID NO:1031;

a first monomer comprising SEQ ID NO:1032, a second monomer comprising SEQ ID NO:1033, and a light chain comprising SEQ ID NO:1034;

a first monomer comprising SEQ ID NO:1035, a second monomer comprising SEQ ID NO:1051, and a light chain comprising SEQ ID NO:1052;

a first monomer comprising SEQ ID NO:1036, a second monomer comprising SEQ ID NO:1037, and a light chain comprising SEQ ID NO:1038; and a first monomer comprising SEQ ID NO:1039, a second monomer comprising SEQ ID NO:1040, and a light chain comprising SEQ ID NO:1041.

\* \* \* \* \*